US008216580B2

(12) United States Patent
Nawroth et al.

(10) Patent No.: US 8,216,580 B2
(45) Date of Patent: Jul. 10, 2012

(54) SULFATASES AND METHODS OF USE THEREOF

(75) Inventors: Roman Nawroth, San Francisco, CA (US); Steven D. Rosen, San Francisco, CA (US)

(73) Assignee: The Regents of the University of California, Oakland, CA (US)

( * ) Notice: Subject to any disclaimer, the term of this patent is extended or adjusted under 35 U.S.C. 154(b) by 786 days.

(21) Appl. No.: 12/163,761

(22) Filed: Jun. 27, 2008

(65) Prior Publication Data

US 2009/0017022 A1 Jan. 15, 2009

Related U.S. Application Data

(63) Continuation of application No. 11/219,360, filed on Sep. 2, 2005, now abandoned, which is a continuation-in-part of application No. 10/265,071, filed on Oct. 3, 2002, now abandoned, which is a continuation-in-part of application No. 10/025,966, filed on Dec. 21, 2001, now abandoned.

(60) Provisional application No. 60/258,577, filed on Dec. 27, 2000, provisional application No. 60/267,831, filed on Feb. 9, 2001.

(51) Int. Cl.
*A61K 39/395* (2006.01)
*C07K 16/40* (2006.01)

(52) U.S. Cl. ............ 424/146.1; 424/130.1; 424/133.1; 424/134.1; 424/135.1; 424/138.1; 424/139.1; 424/141.1; 424/156.1

(58) Field of Classification Search .............. 424/130.1, 424/133.1, 134.1, 135.1, 138.1, 139.1, 141.1, 424/146.1, 156.1
See application file for complete search history.

(56) References Cited

U.S. PATENT DOCUMENTS

| | | | |
|---|---|---|---|
| 5,318,957 A | 6/1994 | Cid et al. | |
| 5,695,752 A | 12/1997 | Rosen et al. | |
| 5,925,349 A | 7/1999 | Rosen et al. | |
| 6,461,847 B1 | 10/2002 | Ye et al. | |
| 6,534,203 B2 | 3/2003 | Iwasaki et al. | |
| 6,534,302 B1 | 3/2003 | Glucksmann et al. | |
| 6,562,956 B1 | 5/2003 | Emerson et al. | |
| 6,716,880 B2 | 4/2004 | Li et al. | |
| 2003/0013167 A1 | 1/2003 | Ye et al. | |
| 2003/0166283 A1* | 9/2003 | Glucksmann et al. | 435/456 |
| 2005/0265987 A1 | 12/2005 | Rosen et al. | |
| 2006/0063230 A1 | 3/2006 | Naworth et al. | |

FOREIGN PATENT DOCUMENTS

| | | |
|---|---|---|
| WO | WO9853071 | 11/1998 |
| WO | WO9954448 | 10/1999 |
| WO | WO9963088 | 12/1999 |
| WO | WO0006086 | 2/2000 |
| WO | WO0055629 | 9/2000 |
| WO | WO0100828 | 1/2001 |
| WO | WO0102568 | 1/2001 |
| WO | WO0121640 | 3/2001 |
| WO | WO0140269 | 6/2001 |
| WO | WO0142467 | 6/2001 |
| WO | WO0155411 | 8/2001 |
| WO | WO0157058 | 8/2001 |
| WO | WO0159127 | 8/2001 |
| WO | WO02048337 | 6/2002 |
| WO | WO02052019 | 7/2002 |
| WO | WO02059327 | 8/2002 |

OTHER PUBLICATIONS

Dai, Y., et al., The Journal of Biological Chemistry, 280(48): 40066-40073, 2005.*
Peterson, S.M., et al. BMC Cancer 10: 427, 2010.*
Rosen, S.D., et al., Expert Opin. Ther. Targets, 14(9): 935-949, 2010.*
Lai, J.-P., et al. J. Gastrointest. Canc. 39: 149-158, 2008.*
Dealmeida et al. The soluble wnt receptor frizzledCRD-hFc inhibits the growth of teratocarcinomas in vivo. Cancer Res, 2007; 67:(11) pp. 5371-5379.
Klaus and Birchmeier. Wnt signalling and its impact on development and cancer. Nature Reviews Cancer, 2008, vol. 8, pp. 387-398.
Groen, et al. Illegitimate WNT pathway activation by B-caterin mutation or autocrine stimulation in t-cell malignancies. Cancer Res, 2008, 68:(17), pp. 6969-6977.
Nawroth, et al. Extracellular sulfatases, elements of the wnt signaling pathway, positively regulate growth and tumorigenicity of human pancreatic cancer cells. PLoS One, 2004, issue 4, e392, pp. 1-11.
Lai, et al. Sulfatase 2 up-regulates glypican 3, promotes fibroblast growth factor signaling, and decreases survival in hepatocellular carcinoma. Hepatology, 2008, vol. 47, No. 4, pp. 1211-1222.
Morimoto-Tomita, et al. Sulf-2, a proangiogenic heparan sulfate endosulfatase, is upregulated in breast Cancer1. Neoplasia, 2005, vol. 7 No. 11, pp. 1001-1010.
Schlange, et al. Autocrine wnt signaling contributes to breast cancer cell proliferation via the canonical wnt pathway and egfr transactivation. Breast Cancer Res, 2007, 9:R63, pp. 1-15. Lemjabbar-Alaoui et al., "Sulf-2, a heparan sulfate endosulfatase, promotes human lung carcinogenesis", *Oncogene*, 29(5):635-655 (2010).
Li et al., "Enhanced levels of Hsulf-1 interfere with heparin-binding growth factor signaling in pancreatic cancer", *Molecular Cancer*, 4:14 (2005).
Nawroth et al., "Extracellular Sulfatases, Elements of the Wnt Signaling Pathway, Positively Regulate Growth and Tumorigenicity of Human Pancreatic Cancer Cells", *PLoS One*, 2:e392 (2007).
Rosen et al., "Sulf-2: an extracellular modulator of cell signaling and a cancer target candidate", *Expert Opinion Ther. Targets*, 14(9):935 (2010).
Sjöblom, et al., "The Consensus Coding Sequences of Human Breast ad Colorectal Cancers", Science, 2006, 314: 268-274.
Sjöblom, et al., 2006, Science, Table, 30 pages.
A. Branch. Tend in Biochem. Sci., 1998,vol. 23, pp. 45-50.
Opalinska, J.B. et al. Nature Reviews, 2002, vol. 1, pp. 503-513.
Chirila, T.V. et al. Biomaterials, 2002, vol. 23, pp. 321-342.
A. Peracchi. Rev. in Med. Virology, 2004, pp. 47-64.
Agrawal, S. et al. Molecular Med. Today, 2000, vol. 6, pp. 72-81.
S. Cooke. Antisense Research & Application, Chapter 1, pp. 1-50 (Ed. By S. Cooke, Publ. By Springer-Verlag 19980.
Adam et al. Nature, 1995, vol. 377, pp. 3-174.

(Continued)

*Primary Examiner* — Alana Harris Dent
*Assistant Examiner* — Anne Holleran
(74) *Attorney, Agent, or Firm* — Paula A. Borden; Bozicevic, Field & Francis LLP.

(57) ABSTRACT

Novel sulfatases and polypeptides related thereto, as well as nucleic acid compositions encoding the same, are provided. The subject polypeptides and nucleic acid compositions find use in a variety of applications, including various diagnostic and therapeutic agent screening applications. Also provided are methods of inhibiting tumor-induced angiogenesis and methods of treating disease conditions associated therewith, particularly by administering an inhibitor of a subject sulfatase.

33 Claims, 35 Drawing Sheets

OTHER PUBLICATIONS

Bergers et al. Matrix metalloproteinase-9 triggers the angiogenic switch during carcinogenesis. Nature Cell biol., 2000, vol. 2, pp. 737-744.
Dhoot, et al. Regulation of wnt signaling and embryo patterning by an extracellular sulfatase. Science, 2001, vol. 293, pp. 1663-1666.
Folkman et al. Seminars in Cancer Biology, 1992, vol. 3, pp. 89-96.
Folkman et al. Blood vessel formation: what is its molecular basis? Cell, 1996, vol. 87, pp. 1153-1155.
Hanahan et al. Patterns and Emerging Mechanisms of the Angiogenic switch during tunorigenesis. Cell, 1996, vol. 86, pp. 353-364.
Kikuno et al. Prediction of the coding sequences of unidentified human genes XIV. The complete sequences of 100 new cDNA clones from brain which code for large proteins in vitro. DNA Reseach, 1999, vol. 6, pp. 197-205.
Knaust et al. (1998) Biochem. 37:13941.
Lukatela et al. (1998) Biochem. 37:3654.
Nagase et al. (1999) "Prediction of the coding sequences of unidentified human genes. XV. The Complete sequences of 100 new cDNA clomes from Brain which code for large proteins in vitro", DNA Research, 6:337-345.
Parenti et al. (1997) Curr. Opinion Genet. Devel. 7:386-391.
Robertson et al. (1988) Biochem. Biophys. Res. Commun., 157:218-224.
Robertson et al. (1992) Biochem. J. 288:539-544.
Robertison et al. (1993) Biochem J. 293:683-689.
Robertson et al. (1988) Hum. Genet. 79:175-178.
Rosen et al. (2002) "New fusion protein for treating disease e.g. diabetes comprises an albumin fused to a therapeutic protein", Database accession No. ABG63903; XP-00222586.
Ruben et al. (2001) "Human gene 5 encoded secreted protein HE9QN39, SEQ ID No: 95", Database Accession No. AE01440; XP-002223584.
Tang et al. (2001) "Nucleic acids encoding polypeptides with cytokine-like activites, useful in diagnosis and gene therapy", Database accession No. AAM79215; XP-002223585.
Tomatsu et al. (1991) Biochem. Biophys. Res. Commun., 181:677-683.
Yancopoulos et al. Vasculogenesis, Angiogenesis, and Growth Factors: Ephrins Enter the Fray at the Border, (1998) Cell 93:661-4.
Genbank Accession No. AA438825 (Apr. 24, 1997).
Genbank Accession No. AA391898 (Apr. 24, 1997).
Genbank Accession No. AB029000 (Aug. 3, 1999).
Genbank Accession No. AI344026 (Apr. 7, 2002).
Genbank Accession No. AA361498 (Apr. 21, 1997).
Genbank Accession No. AA015479 (Jul. 31, 1996).
Genbank Accession No. AA138508 (Apr. 5, 1996).
Genbank Accession No. AA461855 (Jun. 11, 1997).
Genbank Accession No. AA727360 (Jan. 3, 1998).
Genbank Accession No. AA323130 (Apr. 20, 1997).
Baird et al. (1987) Biochem. Biophys. Res. Commun, vol. 142(2), pp. 428-435.
Morimoto-Tomita et al. (2002) J. Biol. Chem., vol. 277(51), pp. 49175-49185.
U.S. Appl. No. 60/257,082, filed Dec. 21, 2000, Glucksman.

* cited by examiner

\>human SULF1 full length cDNA (ORF highlighted in capitals)
ccacccaccatcatctaaagaagataaacttggcgaatgacatgcaggttcttcaaggcagaataattgcagaaaatcttc
aaaggaccctatctgcagatgttctgaatacctctgagaatagagattgattattcaaccaggatacctaattcaaggactcc
agaaatcaggagacggagacattttgtcagttttgcaacattggaccaaaatacaATGAAGTATTCTTGCTGTG
CTCTGGTTTTGGCTGTCCTGGGCACAGAATTGCTGGGAAGCCTCTGTTCGACTGTC
AGATCCCCGAGGTTCAGAGGACGGATACAGCAGGAACGAAAAAACATCCGACCCAA
CATTATTCTTGTGCTTACCGATGATCAAGATGTGGAGCTGGGGTCCCTGCAAGTCAT
GAACAAAACGAGAAAGATTATGGAACATGGGGGGCCACCTTCATCAATGCCTTTGT
GACTACACCCATGTGCTGCCCGTCACGGTCCTCCATGCTCACCGGGAAGTATGTGC
ACAATCACAATGTCTACACCAACAACGAGAACTGCTCTTCCCCCTCGTGGCAGGCCA
TGCATGAGCCTCGGACTTTTGCTGTATATCTTAACAACACTGGCTACAGAACAGCCTT
TTTTTGGAAAATACCTCAATGAATATAATGGCAGCTACATCCCCCCTGGGTGGCGAGAA
TGGCTTGGATTAATCAAGAATTCTCGCTTCTATAATTACACTGTTTGTCGCAATGGCAT
CAAAGAAAAGCATGGATTTGATTATGCAAAGGACTACTTCACAGACTTAATCACTAAC
GAGAGCATTAATTACTTCAAAATGTCTAAGAGAATGTATCCCCATAGGCCCGTTATGAT
GGTGATCAGCCACGCTGCGCCCACGGCCCGAGGACTCAGCCCCACAGTTTTCT
AAACTGTACCCCAATGCTTCCCAACACATAACTCCTAGTTATAACTATGCACCAAATAT
GGATAAACACTGGATTATGCAGTACACAGGACCAATGCTGCCCATCCACATGGAATTT
ACAAACATTCTACAGCGCAAAAGGCTCCAGACTTTGATGTCAGTGGATGATTCTGTG
GAGAGGCTGTATAACATGCTCGTGGAGACGGGGGAGCTGGAGAATACTTACATCATT
TACACCGCCGACCATGGTTACCATATTGGGCAGTTTGGACTGGTCAAGGGGAAATCC
ATGCCATATGACTTTGATATTCGTGTGCCTTTTTTATTCGTGGTCCAAGTGTAGAACC
AGGATCAATAGTCCCACAGATCGTTCTCAACATTGACTTGGCCCCCACGATCCTGGA
TATTGCTGGGCTCGACACACCTCCTGATGTGGACGGCAAGTCTGTCCTCAAACTTCT
GGACCCAGAAAAGCCAGGTAACAGGTTTCGAACAAACAAGAAGGCCAAAATTTGGC
GTGATACATTCCTAGTGGAAAGAGGCAAATTTCTACGTAAGAAGGAAGAATCCAGCA
AGAATATCCAACAGTCAAATCACTTGCCCAAATATGAACGGGTCAAAGAACTATGCCA
GCAGGCCAGGTACCAGACAGCCTGTGAACAACCGGGGCAGAAGTGGCAATGCATT
GAGGATACATCTGGCAAGCTTCGAATTCACAAGTGTAAAGGACCCAGTGACCTGCTC
ACAGTCCGGCAGAGCACGCGGAACCTCTACGCTCGCGGCTTCCATGACAAAGACAA
AGAGTGCAGTTGTAGGGAGTCTGGTTACCGTGCCAGCAGAAGCCAAAGAAAGAGTC
AACGGCAATTCTTGAGAAACCAGGGGACTCCAAAGTACAAGCCCAGATTTGTCCATA
CTCGGCAGACACGTTCCTTGTCCGTCGAATTTGAAGGTGAAATATATGACATAAATCT
GGAAGAAGAAGAAGAATTGCAAGTGTTGCAACCAAGAAACATTGCTAAGCGTCATGA
TGAAGGCCACAAGGGGCCAAGAGATCTCCAGGCTTCCAGTGGTGGCAACAGGGGC
AGGATGCTGGCAGATAGCAGCAACGCCGTGGGCCCACCTACCACTGTCCGAGTGA
CACACAAGTGTTTTATTCTTCCCAATGACTCTATCCATTGTGAGAGAGAACTGTACCA
ATCGGCCAGAGCGTGGAAGGACCATAAGGCATACATTGACAAAGAGATTGAAGCTCT
GCAAGATAAAATTAAGAATTTAAGAGAAGTGAGAGGACATCTGAAGAGAAGGAAGCC
TGAGGAATGTAGCTGCAGTAAACAAAGCTATTACAATAAAGAGAAAGGTGTAAAAAAG
CAAGAGAAATTAAAGAGCCATCTTCACCCATTCAAGGAGGCTGCTCAGGAAGTAGAT
AGCAAACTGCAACTTTTCAAGGAGAACAACCGTAGGAGGAAGAAGGAGAGGAAGGA
GAAGAGACGGCAGAGGAAGGGGAAGAGTGCAGCCTGCCTGGCCTCACTTGCTTC
ACGCATGACAACAACCACTGGCAGACAGCCCCGTTCTGGAACCTGGGATCTTTCTG
TGCTTGCACGAGTTCTAACAATAACACCTACTGGTGTTTGCGTACAGTTAATGAGACG
CATAATTTTCTTTTCTGTGAGTTTGCTACTGGCTTTTGGAGTATTTTGATATGAATACA
GATCCTTATCAGCTCACAAATACAGTGCACACGGTAGAACGAGGCATTTTGAATCAG
CTACACGTACAACTAATGGAGCTCAGAAGCTGTCAAGGATATAAGCAGTGCAACCCA
AGACCTAAGAATCTTGATGTTGGAAATAAAGATGGAGGAAGCTATGACCTACACAGAG
GACAGTTATGGGATGGATGGGAAGGTTAAAAtcagcccgtctcactgcagacatcaactggcaaggc

FIG. 1A ctagaggagctacacagtgtgaatgaaaacatctatgagtacagacaaaactacagacttagtctggtggac
tggactaattacttgaaggatttagatagagtatttgcactgctgaagagtcactatgagcaaaataaaacaaa
taagactcaaactgctcaaagtgacgggttcttggttgtctctgctgagcacgctgtgtcaatggagatggcctct
gctgactcagatgaagacccaaggcataaggttgggaaaacacctcatttgaccttgccagctgaccttcaa
accctgcatttgaaccgaccaacattaagtccagagagtaaacttgaatggaataacgacattccagaagtta
atcatttgaattctgaacactggagaaaaaccgaaaaatggacggggcatgaagagactaatcatctggaa
accgatttcagtggcgatggcatgacagagctagagctcgggcccagccccaggctgcagcccattcgcag
gcacccgaaagaacttccccagtatggtggtcctggaaaggacattttgaagatcaactatatcttcctgtgca
ttccgatggaatttcagttcatcagatgttcaccatggccaccgcagaacaccgaagtaattccagcatagcgg
ggaagatgttgaccaaggtggagaagaatcacgaaaggagaagtcacagcacctagaaggcagcgcc
tcctcttcactctcctctgattagatgaaactgttaccttaccctaaacacagtatttcttttttaactttttttatttgtaaact
aataaaggtaatcacagccaccaacattccaagctaccctgggtacctttgtgcagtagaagctagtgagcat
gtgagcaagcggtgtgcacacggagactcatcgttataatttactatctgccaagagtagaaagaaaggctg
gggatatttggttggcttggttttgatttttttgcttgtttgtttgttttgtactaaaacagtattatcttttgaatatcgtagg
gacataagtatatacatgttatccaatcaagatggctagaatggtgcctttctgagtgtctaaaacttgacacccc
tggtaaatctttcaacacacttccactgcctgcgtaatgaagttttgattcatttttaaccactggaatttttcaatgcc
gtcattttcagttagatgattttgcactttgagattaaaatgccatgtctatttgattagtcttatttttttattttttacaggctt
atcagtctcactgttggctgtcattgtgacaaagtcaaataaaccccccaaggacgacacacagtatggatcac
atattgtttgacattaagcttttgccagaaaatgttgcatgtgttttacctcgacttgctaaaatcgattagcagaaa
ggcatggctaataatgttggtggtgaaaataaataaataagtaaacaaaatgaagattgcctgctctctctgtgc
ctagcctcaaagcgttcatcatacatcataccttaagattgctatattttgggttatttcttgacaggagaaaaag
atctaaagatctttttattttcatcttttttggttttcttggcatgactaagaagcttaaatgttgataaaatatgactagttt
tgaatttacaccaagaacttctcaataaaagaaaatcatgaatgctccacaatttcaacataccacaagagaa
gttaatttcttaacattgtgttctatgattatttgtaagaccttcaccaagttctgatatcttttaaagacatagttcaaa
attgcttttgaaaatctgtattcttgaaaatatccttgttgtgtattaggttttaaataccagctaaaggattacctcac
tgagtcatcagtaccctcctattcagctccccaagatgatgtgttttttgcttaccctaagagaggttttcttcttatttt
agataattcaagtgcttagataaattatgttttctttaagtgtttatggtaaactcttttaaagaaaatttaatatgttata
gctgaatcttttggtaactttaaatctttatcatagactctgtacatatgttcaaattagctgcttgcctgatgtgtgtat
catcggtgggatgacagaacaaacatatttatgatcatgaataatgtgctttgtaaaaagatttcaagttattagg
aagcatactctgttttttaatcatgtataatattccatgatactttatagaacaattctggcttcaggaaagtctaga
agcaatatttcttcaaataaaaggtgtttaaactttaaaaaaaaaaaaaaaaaaaaaaaaaaaaaaaaaa
```

FIG. 1B

>human SULF1 amino acid sequence--translation of ORF
MKYSCCALVLAVLGTELLGSLCSTVRSPRFRGRIQQERKNIRPNIILVLTDDQDVELG
SLQVMNKTRKIMEHGGATFINAFVTTPMCCPSRSSMLTGKYVHNHNVYTNNENCS
SPSWQAMHEPRTFAVYLNNTGYRTAFFGKYLNEYNGSYIPPGWREWLGLIKNSRF
YNYTVCRNGIKEKHGFDYAKDYFTDLITNESINYFKMSKRMYPHRPVMMVISHAAP
HGPEDSAPQFSKLYPNASQHITPSYNYAPNMDKHWIMQYTGPMLPIHMEFTNILQR
KRLQTLMSVDDSVERLYNMLVETGELENTYIIYTADHGYHIGQFGLVKGKSMPYDF
DIRVPFFIRGPSVEPGSIVPQIVLNIDLAPTILDIAGLDTPPDVDGKSVLKLLDPEKPG
NRFRTNKKAKIWRDTFLVERGKFLRKKEESSKNIQQSNHLPKYERVKELCQQARY
QTACEQPGQKWQCIEDTSGKLRIHKCKGPSDLLTVRQSTRNLYARGFHDKDKECS
CRESGYRASRSQRKSQRQFLRNQGTPKYKPRFVHTRQTRSLSVEFEGEIYDINLE
EEEELQVLQPRNIAKRHDEGHKGPRDLQASSGGNRGRMLADSSNAVGPPTTVRV
THKCFILPNDSIHCERELYQSARAWKDHKAYIDKEIEALQDKIKNLREVRGHLKRRK
PEECSCSKQSYYNKEKGVKKQEKLKSHLPFKEAAQEVDSKLQLFKENNRRRKKE
RKEKRRQRKGEECSLPGLTCFTHDNNHWQTAPFWNLGSFCACTSSNNNTYWCL
RTVNETHNFLFCEFATGFLEYFDMNTDPYQLTNTVHTVERGILNQLHVQLMELRSC
QGYKQCNPRPKNLDVGNKDGGSYDLHRGQLWDGWEG

FIG. 1C

>human SULF2 full length cDNA (ORF highlighted in capitals)
TGAgactcccgcatcccaaaagaagcaccagatcagcaaaaaaagaagATGGGCCCCCCGAGCCTCGT
GCTGTGCTTGCTGTCCGCAACTGTGTTCTCCCTGCTGGGTGGAAGCTCGGCCTTCCT
GTCGCACCACCGCCTGAAAGGCAGGTTTCAGAGGGACCGCAGGAACATCCGCCCCA
ACATCATCCTGGTGCTGACGGACGACCAGGATGTGGAGCTGGGTTCCATGCAGGTG
ATGAACAAGACCCGGCGCATCATGGAGCAGGGCGGGGCGCACTTCATCAACGCCTT
CGTGACCACACCCATGTGCTGCCCCTCACGCTCCTCCATCCTCACTGGCAAGTACGT
CCACAACCACAACACCTACACCAACAATGAGAACTGCTCCTCGCCCTCCTGGCAGGC
ACAGCACGAGAGCCGCACCTTTGCCGTGTACCTCAATAGCACTGGCTACCGGACAGC
TTTCTTCGGGAAGTATCTTAATGAATACAACGGCTCCTACGTGCCACCCGGCTGGAAG
GAGTGGGTCGGACTCCTTAAAAACTCCCGCTTTTATAACTACACGCTGTGTCGGAACG
GGGTGAAAGAAAAGCACGGCTCCGACTACTCCAAGGATTACCTCACAGACCTCATCA
CCAATGACAGCGTGAGCTTCTTCCGCACGTCCAAGAAGATGTACCCGCACAGGCCAG
TCCTCATGGTCATCAGCCATGCAGCCCCCACGGCCCTGAGGATTCAGCCCCACAAT
ATTCACGCCTCTTCCCAAACGCATCTCAGCACATCACGCCGAGCTACAACTACGCGC
CCAACCCGGACAAACACTGGATCATGCGCTACACGGGGCCCATGAAGCCCATCCACA
TGGAATTCACCAACATGCTCCAGCGGAAGCGCTTGCAGACCCTCATGTCGGTGGACG
ACTCCATGGAGACGATTTACAACATGCTGGTTGAGACGGGCGAGCTGGACAACACGT
ACATCGTATACACCGCCGACCACGGTTACCACATCGGCCAGTTTGGCCTGGTGAAAG
GGAAATCCATGCCATATGAGTTTGACATCAGGGTCCCGTTCTACGTGAGGGGCCCCA
ACGTGGAAGCCGGCTGTCTGAATCCCCACATCGTCCTCAACATTGACCTGGCCCCCA
CCATCCTGGACATTGCAGGCCTGGACATACCTGCGGATATGGACGGGAAATCCATCCT
CAAGCTGCTGGACACGGAGCGGCCGGTGAATCGGTTTCACTTGAAAAAGAAGATGA
GGGTCTGGCGGGACTCCTTCTTGGTGGAGAGAGGCAAGCTGCTACACAAGAGAGAC
AATGACAAGGTGGACGCCCAGGAGGAGAACTTTCTGCCCAAGTACCAGCGTGTGAA
GGACCTGTGTCAGCGTGCTGAGTACCAGACGGCGTGTGAGCAGCTGGGACAGAAGT
GGCAGTGTGTGGAGGACGCCACGGGGAAGCTGAAGCTGCATAAGTGCAAGGGCCC
CATGCGGCTGGGCGGCAGCAGAGCCCTCTCCAACCTCGTGCCCAAGTACTACGGGC
AGGGCAGCGAGGCCTGCACCTGTGACAGCGGGGACTACAAGCTCAGCCTGGCCGG
ACGCCGGAAAAAACTCTTCAAGAAGAAGTACAAGGCCAGCTATGTCCGCAGTCGCTC
CATCCGCTCAGTGGCCATCGAGGTGGACGGCAGGGTGTACCACGTAGGCCTGGGTG
ATGCCGCCAGCCCCGAAACCTCACCAAGCGGCACTGGCCAGGGGCCCTGAGGA
CCAAGATGACAAGGATGGTGGGGACTTCAGTGGCACTGGAGGCCTTCCCGACTACT
CAGCCGCCAACCCCATTAAAGTGACACATCGGTGCTACATCCTAGAGAACGACACAG
TCCAGTGTGACCTGGACCTGTACAAGTCCCTGCAGGCCTGGAAAGACCACAAGCTG
CACATCGACCACGAGATTGAAACCCTGCAGAACAAAATTAAGAACCTGAGGGAAGTC
CGAGGTCACCTGAAGAAAAGCGGCCAGAAGAATGTGACTGTCACAAAATCAGCTAC
CACACCCAGCACAAAGGCCGCCTCAAGCACAGAGGCTCCAGTCTGCATCCTTTCAG
GAAGGGCCTGCAAGAGAAGGACAAGGTGTGGCTGTTGCGGGAGCAGAAGCGCAAG
AAGAAACTCCGCAAGCTGCTCAAGCGCCTGCAGAACAACGACACGTGCAGCATGCC
AGGCCTCACGTGCTTCACCCACGACAACCAGCACTGGCAGACGGCGCCTTTCTGGA
CACTGGGGCCTTTCTGTGCCTGCACCAGCGCCAACAATAACACGTACTGGTGCATGA
GGACCATCAATGAGACTCACAATTTCCTCTTCTGTGAATTTGCAACTGGCTTCCTAGA
GTACTTTGATCTCAACACAGACCCCTACCAGCTGATGAATGCAGTGAACACACTGGAC
AGGGATGTCCTCAACCAGCTACACGTACAGCTCATGGAGCTGAGGAGCTGCAAGGGT
TACAAGCAGTGTAACCCCCGGACTCGAAACATGGACCTGGGACTTAAAGATGGAGGA
AGCTATGAGCAATACAGGCAGTTTCAGCGTCGAAAGTGGCCAGAAATGAAGAGACCT
TCTTCCAAATCACTGGGACAACTGTGGGAAGGCTGGGAAGGTTAAgaaacaacagaggtgg

FIG. 2A acctccaaaaacatagaggcatcacctgactgcacaggcaatgaaaaaccatgtgggtgatttccagcagacctgtgctat
tggccaggaggcctgagaaagcaagcacgcactctcagtcaacatgacagattctggaggataaccagcaggagcaga
gataacttcaggaagtccattttgcccctgcttttgctttggattatacctcaccagctgcacaaaatgcattttttcgtatcaaaa
agtcaccactaaccctcccccagaagctcacaaaggaaaacggagagagcgagcgagagagatttccttggaaatttctc
ccaagggcgaaagtcattggaattttaaatcataggggaaaagcagtcctgttctaaatcctcttattcttttggtttgtcacaaa
gaaggaactaagaagcaggacagaggcaacgtggagaggctgaaaacagtgcagagacgtttgacaatgagtcagta
gcacaaaagagatgacatttacctagcactataaaccctggttgcctctgaagaaactgccttcattgtatatatgtgactattta
catgtaatcaacatgggaacttttaggggaacctaataagaaatcccaattttcaggagtggtggtgtcaataaacgctctgtg
gccagtgtaaaagaaaaaaaaaaaaaa

FIG. 2B

>human SULF2 amino acid sequence--translation of ORF
MGPPSLVLCLLSATVFSLLGGSSAFLSHHRLKGRFQRDRRNIRPNIILVLTDDQDVELGS
MQVMNKTRRIMEQGGAHFINAFVTTPMCCPSRSSILTGKYVHNHNTYTNNENCSSPSW
QAQHESRTFAVYLNSTGYRTAFFGKYLNEYNGSYVPPGWKEWVGLLKNSRFYNYTLC
RNGVKEKHGSDYSKDYLTDLITNDSVSFFRTSKKMYPHRPVLMVISHAAPHGPEDSAP
QYSRLFPNASQHITPSYNYAPNPDKHWIMRYTGPMKPIHMEFTNMLQRKRLQTLMSVD
DSMETIYNMLVETGELDNTYIVYTADHGYHIGQFGLVKGKSMPYEFDIRVPFYVRGPNV
EAGCLNPHIVLNIDLAPTILDIAGLDIPADMDGKSILKLLDTERPVNRFHLKKKMRVWRDS
FLVERGKLLHKRDNDKVDAQEENFLPKYQRVKDLCQRAEYQTACEQLGQKWQCVEDA
TGKLKLHKCKGPMRLGGSRALSNLVPKYYGQGSEACTCDSGDYKLSLAGRRKKLFKKK
YKASYVRSRSIRSVAIEVDGRVYHVGLGDAAQPRNLTKRHWPGAPEDQDDKDGGDFS
GTGGLPDYSAANPIKVTHRCYILENDTVQCDLDLYKSLQAWKDHKLHIDHEIETLQNKIK
NLREVRGHLKKKRPEECDCHKISYHTQHKGRLKHRGSSLHPFRKGLQEKDKVWLLRE
QKRKKKLRKLLKRLQNNDTCSMPGLTCFTHDNQHWQTAPFWTLGPFCACTSANNNTY
WCMRTINETHNFLFCEFATGFLEYFDLNTDPYQLMNAVNTLDRDVLNQLHVQLMELRS
CKGYKQCNPRTRNMDLGLKDGGSYEQYRQFQRRKWPEMKRPSSKSLGQLWEGWEG

FIG. 2C

>mouse SULF1 full length cDNA (ORF fragments highlighted in capitals)
cttcaccttgagaaggtgaatttccctaaagacatgcagtttcttcaagccagaatccttgcagggaaccttcaaaggactcct
tctgcagatgttttggaaacctctgagtctagaaatcgattattcacccaggataccttattcaagctcccagaactcacccgac
caaggagcttggaagactttgcaactttggaccaagcacaATGAAGTATTCCCTCTGGGCTCTGCTGCT
TCCCCTGCTGGGCACACAGCTGCTGGGAACCCTGTGTTCCACCGTTCGGTCCCAGA
GGTTCCGAGGAAGGATACAGCAGGAACGAAAAAACATCCGACCCAACATTATTCTTG
TGCTTACCGATGATCAAGATGTGGAGCTGGGGTCCCTGCAAGTCATGAACAAAACGA
GAAAGATTATGGAACATGGGGGGGCCACCTTCATCAATGCCTTTGTGACTACACCCA
TGTGCTGCCCGTCACGGTCCTCCATGCTCACCGGGAAGTATGTGCACAATCACAATG
TCTACACCAACAACGAGAACTGCTCTTCCCCCTCGTGGCAGGCCATGCATGAGCCT
CGGACTTTTGCTGTATATCTTAACAACACTGGCTACAGAACAGCCTTTTTTGGAAAATA
CCTCAATGAATATAATGGCAGCTACATCCCCCCTGGGTGGCGAGAATGGCTTGGATTA
ATCAAGAATTCTCGCTTCTATAATTACACTGTTTGTCGCAATGGCATCAAAGAAAAGCA
TGGATTTGATTATGCAAAGGACTACTTCACAGACTTAATCACTAACGAGAGCATTAATT
ACTTCAAAATGTCTAAGAGAATGTATCCCCATAGGCCCGTTATGATGGTGATCAGCCA
CGCTGCGCCCCACGGCCCCGAGGACTCAGCCCCACAGTTTTCTAAACTGTACCCCA
ATGCTTCCCAACACATAACTCCTAGTTATAACTATGCACCAAATATGGATAAACACTGG
ATTATGCAGTACACAGGACCAATGCTGCCCATCCACATGGAATTTACAAACATTCTACA
GCGCAAAAGGCTCCAGACTTTGATGTCAGTGGATGATTCTGTGGAGAGGCTGTATAA
CATGCTCGTGGAGACGGGGGAGCTGGAGAATACTTACATCATTTACACCGCCGACCA
TGGTTACCATATTGGGCAGTTTGGACTGGTCAAGGGGAAATCCATGCCATATGACTTT
GATATTCGTGTGCCTTTTTTATTCGTGGTCCAAGTGTAGAACCAGGATCAATAGTCC
CACAGATCGTTCTCAACATTGACTTGGCCCCACGATCCTGGATATTGCTGGGCTCG
ACACACCTCCTGATGTGGACGGCAAGTCTGTCCTCAAACTTCTGGACCCAGAAAAG
CCAGGTAACAGGTTTCGAACAAACAAGAAGGCCAAAATTTGGCGTGATACATTCCTA
GTGGAAAGAGGCAAATTTCTACGTAAGAAGGAAGAATCCAGCAAGAATATCCAACAG
TCAAATCACTTGCCCAAATATGAACGGGTCAAAGAACTATGCCAGCAGGCCAGGTAC
CAGACAGCCTGTGAACAACCGGGGCAGAAGTGGCAATGCATTGAGGATACATCTGG
CAAGCTTCGAATTCACAAGTGTAAAGGACCCAGTGACCTGCTCACAGTCCGGCAGA
GCACGCGGAACCTCTACGCTCGCGGCTTCCATGACAAAGACAAAGAGTGCAGTTGT
AGGGAGTCTGGTTACCGTGCCAGCAGAAGCCAAAGAAAGAGTCAACGGCAATTCTT
GAGAAACCAGGGGACTCCAAAGTACAAGCCCAGATTTGTCCATACTCGGCAGACAC
GTTCCTTGTCCGTCGAATTTGAAGGTGAAATATATGACATAAATCTGGAAGAAGAAGA
AGAATTGCAAGTGTTGCAACCAAGAAACATTGCTAAGCGTCATGATGAAGGCCACAA
GGGGCCAAGAGATCTCCAGGCTTCCAGTGGTGGCAACAGGGGCAGGATGCTGGCA
GATAGCAGCAACGCCGTGGGCCCACCTACCACTGTCCGAGTGACACACAAGTGTTT
TATTCTTCCCAATGACTCTATCCATTGTGAGAGAACTGTACCAATCGGCCAGAGCG
TGGAAGGACCATAAGGCCTACATTGATAAAGAGATTGAAGTTCTACAAGATAAAATTAA
GAATTTAAGGGAAGTGAGGGGACACCTAAAGAAAAGGAAACCTGAGGAGTGTAGCT
GTGGTGACCAGAGCTATTACAACAAAGAGAAAGGTGTCAAACGACAGGAGAAGCTAA
AGAGTCACCTTCACCCCTTCAAGGAGGCTGCTGCCCAGGAGGTGGATAGCAAACTT
CAGCTCTTCAAGGAGCATCGGAGGAGGAAGAAGGAGAGGAAGGAGAAGAAACGGC
AGAGGAAGGGAGAGGAGTGTAGCCTGCCTGGCCTTACCTGCTTCACCCATGACAAC
AACCACTGGCAGACTGCCCCATTCTGGAACTTGGGATCTTTCTGTGCCTGCACAAGT
TCTAACAACAATACCTACTGGGTGTTGCGTACAGTCAACGAGACGCACAATTTCCTGT
TTTGTGAGTTTGCTACTGGCTTTCTGGAATATTTCGACATGAATACGGATCCTTATCAG
CTCACAAATACAGTACACACAGTAGAACGAGGCATTTTGAATCAGCTACACGTACAAC

FIG. 3A

```
TAATGGAGCTCAGAAGCTGTCAAGGATATAAGCAGTGCAACCCAAGACCTAAGAAT
CTTGATGTTGGAAATAAAGATGGAGGAAACTATGACCCGCACAGAGGACAGTTATG
GGATGGATGGGAAGGTTAGTCTTTCCAATGTTACTTCAGACACCAGCTGGCAAGG
CCTGGAGGAGTTATCCGGTGCAAGCGACATCGATGAGTACAGGTCTAACCCTAGA
CTAAGTCTGGAGGACTGGACTAACTACCTGAGGGCTGTCTACAGAGCCTTTGCAC
TGCTGAACAGTCACCCTGATCCAAACAAAGCAAATGGGACTCCAACCACACAAGG
TGGTGACTTCCTGGTCACCTCTGCTGAGCGCTTGGTGCCAGCAGAGATGGCTTC
TGCAGAATCAGGTGAAGACCCAAGTCATGTGGTTGGGGAAACACCTCCTTTGACC
TTGCCAGTCAACCTCCAAACCCTGCATCTGAACAGACCAACGTTAAGTCCAGAGA
GAAAACTTGAATGGGATAATGACATTCCAGAAGTGAATCATTTGAATTCTGAACACT
GGAGAAAAACTGAGAAGCAGATAGGATGGGAGGAGCTGCATCATCCTGAAGGTG
ACGTCGTCAGTGGCAATGGTATGACAGAGCTGCTGCCCCAGTCTCATCTTGGGCA
TCAGCTCACCAGTCAGCACCAACAAAAATGTTCCCAGGATGTGGAGACAGAGAAG
GATGCTTTTGAAGATCAATTGCGTCCTCTTGTCCACTCTGACAGAACTCCGGTTCA
TC
```

FIG. 3B

>mouse SULF1 amino acid sequence--translation of ORF
MKYSLWALLLPLLGTQLLGTLCSTVRSQRFRGRIQQERKNIRPNIILVLTDDQDVELGS
LQVMNKTRKIMEHGGATFINAFVTTPMCCPSRSSMLTGKYVHNHNVYTNNENCSSP
SWQAMHEPRTFAVYLNNTGYRTAFFGKYLNEYNGSYIPPGWREWLGLIKNSRFYNY
TVCRNGIKEKHGFDYAKDYFTDLITNESINYFKMSKRMYPHRPVMMVISHAAPHGPE
DSAPQFSKLYPNASQHITPSYNYAPNMDKHWIMQYTGPMLPIHMEFTNILQRKRLQT
LMSVDDSVERLYNMLVETGELENTYIIYTADHGYHIGQFGLVKGKSMPYDFDIRVPFFI
RGPSVEPGSIVPQIVLNIDLAPTILDIAGLDTPPDVDGKSVLKLLDPEKPGNRFRTNKK
AKIWRDTFLVERGKFLRKKEESSKNIQQSNHLPKYERVKELCQQARYQTACEQPGQ
KWQCIEDTSGKLRIHKCKGPSDLLTVRQSTRNLYARGFHDKDKECSCRESGYRASR
SQRKSQRQFLRNQGTPKYKPRFVHTRQTRSLSVEFEGEIYDINLEEEEELQVLQPRN
IAKRHDEGHKGPRDLQASSGGNRGRMLADSSNAVGPPTTVRVTHKCFILPNDSIHCE
RELYQSARAWKDHKAYIDKEIEVLQDKIKNLREVRGHLKKRKPEECSCGDQSYYNKE
KGVKRQEKLKSHLHPFKEAAAQEVDSKLQLFKEHRRRKKERKEKKRQRKGEECSLP
GLTCFTHDNNHWQTAPFWNLGSFCACTSSNNNTYWVLRTVNETHNFLFCEFATGFL
EYFDMNTDPYQLTNTVHTVERGILNQLHVQLMELRSCQGYKQCNPRPKNLDVGNKD
GGNYDPHRGQLWDGWEG

FIG. 3C

>mouse SULF-2 cDNA (ORF in capital letters)
ggacgcgtgggcggacgcgtggggtctgggcaacgcttctgctttcgcttgagctcaacttaatttctcagagagcttcgg
agacgcgtgggaaggtcccaggcgcgtgggcagttcctcccgcgatctagcttgggggatcggcccgagccggcgtctc
caatgatcctgagggaagaggggaaggaatcccatcctcacgacaccacctcggcctctgcatccaggaagaagca
aaggaccagcaagccacgccaATGGCACCCCCTGGCCTGCCACTATGGCTGCTGTCCAC
CGCTCTCCTCTCCCTGCTGGCTGGCAGCTCGGCCTTCCTCTCCCATCCCCGCCT
GAAGGGACGCTTCCAGAGGGACCGCAGGAACATCCGGCCCAACATCATCTTGGT
GCTTACGGATGACCAGGATGTGGAGCTGGGCTCCATGCAAGTGATGAACAAGACA
AGGCGTATCATGGAGCAGGGCGGGGCGCACTTCATCAATGCCTTCGTGACTACAC
CAATGTGCTGTCCGTCTCGCTCCTCCATTCTCACCGGCAAGTACGTCCACAACCA
CAACACCTACACCAACAATGAGAATTGTTCCTCGCCCTCCTGGCAGGCCCAGCAC
GAGAGCCGCACCTTCGCCGTGTATCTCAACAGCACAGGCTACCGGACAGCTTTCT
TCGGAAAATACCTCAATGAGTACAACGGCTCATACGTGCCGCCCGGCTGGAAGGA
GTGGGTCGGCCTACTTAAGAACTCCCGCTTTTATAACTACACACTCTGCCGGAATG
GGGTGAAGGAGAAACATGGCTCAGACTACTCCACGGATTACCTCACGGATCTCAT
CACCAATGACAGTGTGAGCTTCTTCCGAACATCCAAGAAGATGTACCCACACAGG
CCCGTGCTCATGGTCATCAGCCACGCGGCTCCCACGGCCCCGAGGACTCGGC
ACCGCAGTACTCACGGCTCTTCCCCAATGCGTCCCAGCACATCACACCGAGTTAC
AACTATGCACCCAACCCAGACAAGCATTGGATCATGCGCTACACGGGACCCATGA
AGCCCATTCACATGGAATTCACCAACATGCTACAACGCAAACGCCTACAGACCCTC
ATGTCTGTGGATGACTCCATGGAGACGATCTATGACATGCTGGTGGAGACGGGGG
AGCTGGACAACACGTACATCCTGTACACCGCCGACCACGGCTACCACATTGGCCA
GTTTGGCTGGTGAAGGGCAAGTCTATGCCGTATGAATTCGACATCAGAGTCCCG
TTCTACGTGAGGGGCCCCAACGTGGAAGCTGGCTCTCTGAACCCCCACATTGTC
CTCAACATTGACCTGGCCCCCACCATACTGGATATCGCTGGACTGGACATCCCTG
CAGACATGGACGGGAAGTCTATTCTCAAACTACTGGACTCAGAGCGGCCAGTGAA
CCGGTTCCACTTGAAAAAGAAGCTGAGGGTCTGGCGAGACTCCTTCCTGGTGGA
GAGAGGCAAACTGCTCCACAAGAGGGAGGGTGACAAAGTGAATGCCCAGGAGGA
GAACTTCCTGCCCAAGTACCAGCGCGTGAAGGACCTGTGTCAGCGAGCTGAGTA
CCAGACAGCATGCGAACAGCTGGGGCAGAAGTGGCAGTGTGTGGAGGACGCTT
CTGGGACGCTGAAGCTGCACAAATGTAAAGGCCCCATGCGGTTTGGTGGCGGCG
GTGGCAGCAGAGCCCTCTCCAACCTGGTGCCCAAGTATGACGGCCAGAGCAGCG
AGGCCTGCAGCTGTGACAGTGGCGGTGGAGGGGACTACAAACTGGGCCTGGCT
GGACGCCGTAAGCTCTTTAAGAAAAAGTATAAGACCAGCTATGCCCGGAACCGCT
CCATCCGTTCCGTGGCCATCGAGGTGGACGGTGAGATATACCACGTAGGCTTGGA
TACTGTGCCTCAGCCCCGCAACCTTAGCAAGCCGCACTGGCCAGGGGCCCTGA
AGACCAAGATGACAAGGATGGTGGCAGTTTCAGTGGTACTGGTGGCCTTCCAGAT
TATTCTGCCCCCAATCCCATCAAAGTGACCCATCGGTGCTACATCCTTGAGAATGA
CACAGTCCAGTGCGACTTGGACCTGTACAAGTCCCTGCAGGCTTGGAAAGACCA
CAAGCTGCACATCGACCATGAGATCGAAACCCTGCAGAACAAAATTAAGAACCTTC
GAGAAGTCAGGGGTCACCTGAAGAAGAAGCGACCGGAAGAATGTGACTGCCATA
AAATCAGTTACCACAGCCAACACAAAGGCCGTCTCAAGCACAAAGGCTCCAGCCT
GCACCCTTTCAGGAAGGGTCTGCAGGAGAAGGACAAGGTGTGGCTGCTGCGGG
AGCAGAAACGCAAGAAGAAACTGCGCAAGCTGCTCAAACGGCTGCAGAACAACG
ATACGTGCAGCATGCCCGGCCTCACGTGCTTTACCCACGACAACCACCACTGGCA
GACGGCGCCACTCTGGACGCTGGGGCCGTTCTGCGCCTGCACCAGCGCCAACA
ACAACACGTACTGGTGCTTGAGGACCATAAATGAGACCCACAACTTCCTCTTCTGC
GAATTTGCAACCGGCTTCATAGAATACTTTGACCTCAGTACAGACCCCTACCAGCT
GATGAACGCGGTGAACACACTGGACAGGGACGTCCTTAACCAACTGCACGTGCA
GCTCATGGAGCTAAGGAGCTGTAAAGGCTACAAGCAGTGCAACCCCCGGACCCG
CAACATGGACCTGGGGCTTAGAGACGGAGGAAGCTATGAACAATACAGGCAGTTT
CAGCGTCGAAAATGGCCAGAAATGAAGAGACCTTCTTCCAAATCACTGGGACAGC
TATGGGAAGGTTGGGAAGGCTAAgcggccatagagagaggaacctccaaaaccagggggcctcgtgtg

FIG. 4A gctgcccaggccatgcaaaaaacacccgattcccagaagatgaatgttggaactgggagacctgacagaaggcagg
gctgctcttgggacaggaaatcctggaggacagcgcctggactttccgatgctcagtttctttgccctgctttgctctggatca
aacctcactggctgctctgggatgcgtgctcacacctggagtctctgctcacccttcagaggctcacaaagacaaagga
actaatttccatggacacttcctccagagatggaaattgctgggattcgccactcctcccctgcacccctcccccagtcat
ctagggaagcaagcttgttttaaccttcttactctttggagaaagcacggacatcccaggtgctgtcaacctcacagtcttga
caaagtctatagcacaaaacagtaccattcaccaggctggttgacctggctggctcagaagctgccttcaccacatacat
gaccgctcacacgtaaccaacacagggaattgtaggggaatctcactaatatgaaatcccgcttttcaagagtcgcggtg
tcaataaacgctgtggctaggatcaaggataatcccttgagctttcagacatttattcctgcccgggattcgttcctttgttatcc
atcccagaactgatgtttttctaaggtaccgaaaccccaagttgatgtgtgtcctgtgttttaatgacattgtatttgtaaagtttt
gtagtataagtaccatcttacagtgttcctgcccccagccaatgtctagctattggtatgaaaaaaaaaaatctttgaattttg
taaaaaaaaaaaaaa

FIG. 4B

>mouse SULF2 amino acid sequence--translation of ORF
MAPPGLPLWLLSTALLSLLAGSSAFLSHPRLKGRFQRDRRNIRPNIILVLTDDQDVELGSM
QVMNKTRRIMEQGGAHFINAFVTTPMCCPSRSSILTGKYVHNHNTYTNNENCSSPSWQ
AQHESRTFAVYLNSTGYRTAFFGKYLNEYNGSYVPPGWKEWVGLLKNSRFYNYTLCRN
GVKEKHGSDYSTDYLTDLITNDSVSFFRTSKKMYPHRPVLMVISHAAPHGPEDSAPQYS
RLFPNASQHITPSYNYAPNPDKHWIMRYTGPMKPIHMEFTNMLQRKRLQTLMSVDDSM
ETIYDMLVETGELDNTYILYTADHGYHIGQFGLVKGKSMPYEFDIRVPFYVRGPNVEAGSL
NPHIVLNIDLAPTILDIAGLDIPADMDGKSILKLLDSERPVNRFHLKKKLRVWRDSFLVERG
KLLHKREGDKVNAQEENFLPKYQRVKDLCQRAEYQTACEQLGQKWQCVEDASGTLKL
HKCKGPMRFGGGGGSRALSNLVPKYDGQSSEACSCDSGGGGDYKLGLAGRRKLFKKK
YKTSYARNRSIRSVAIEVDGEIYHVGLDTVPQPRNLSKPHWPGAPEDQDDKDGGSFSGT
GGLPDYSAPNPIKVTHRCYILENDTVQCDLDLYKSLQAWKDHKLHIDHEIETLQNKIKNLR
EVRGHLKKKRPEECDCHKISYHSQHKGRLKHKGSSLHPFRKGLQEKDKVWLLREQKRK
KKLRKLLKRLQNNDTCSMPGLTCFTHDNHHWQTAPLWTLGPFCACTSANNNTYWCLRT
INETHNFLFCEFATGFIEYFDLSTDPYQLMNAVNTLDRDVLNQLHVQLMELRSCKGYKQC
NPRTRNMDLGLRDGGSYEQYRQFQRRKWPEMKRPSSKSLGQLWEGWEG

FIG. 4C

> human SULF2 full length cDNA (ORF is highlighted in capitals and a 5' inframe stopcodon is underscored)

ggcacgagggccatttctggacaacagctgctattttcacttgagcccaagttaatttctcggggagttctcgggcgcgcaca
ggcagctcggtttgccctgcgattgagctgcggtcgcggccggcgccggcctctccaatggcaaatgtgtgtggctggag
gcgagcgcgaggctttcggcaaaggcagtcgagtgtttgcagaccggggcgagtcctgtgaaagcagataaaagaaaa
catttattaacgtgtcattacgaggggagcgcccggccggggctgtcgcactcccgcggaacatttggctccctccagctc
ctagagaggagaagaagaaagcggaaaagaggcagattcacgtcgtttccagccaagtggacctgatcgatggccctc
ctgaatttatcacgatatttgatttattagcgatgcccctggtttgtgtgttacgcacacacacgtgcacacaaggctctggctc
gcttccctccctcgtttccagctcctgggcgaatcccacatctgtttcaactctccgcgcgagggcgagcaggagcgagagtgt
gtcgaatctgcgagtgaagagggacgagggaaaagaaacaaagccacagacgcaacttgagactcccgcatcccaa
aagaagcaccagatcagcaaaaaaagaagATGGGCCCCCCGAGCCTCGTGCTGTGCTTGCTG
TCCGCAACTGTGTTCTCCCTGCTGGGTGGAAGCTCGGCCTTCCTGTCGCACCACC
GCCTGAAAGGCAGGTTTCAGAGGGACCGCAGGAACATCCGCCCCAACATCATCCTG
GTGCTGACGGACGACCAGGATGTGGAGCTGGGTTCCATGCAGGTGATGAACAAGA
CCCGGCGCATCATGGAGCAGGGCGGGGCGCACTTCATCAACGCCTTCGTGACCAC
ACCCATGTGCTGCCCCTCACGCTCCTCCATCCTCACCGGCAAGTACGTCCACAACC
ACAACACCTACACCAACAATGAGAACTGCTCCTCGCCCTCCTGGCAGGCACAGCAC
GAGAGCCGCACCTTTGCCGTGTACCTCAATAGCACTGGCTACCGGACAGCTTTCTT
CGGGAAGTATCTTAATGAATACAACGGCTCCTACGTGCCACCCGGCTGGAAGGAGT
GGGTCGGACTCCTTAAAAACTCCCGCTTTTATAACTACACGCTGTGTCGGAACGGGG
TGAAAGAGAAGCACGGCTCCGACTACTCCAAGGATTACCTCACAGACCTCATCACC
AATGACAGCGTGAGCTTCTTCCGCACGTCCAAGAAGATGTACCGCACAGGCCAGT
CCTCATGGTCATCAGCCATGCAGCCCCCACGGCCCTGAGGATTCAGCCCCACAAT
ATTCACGCCTCTTCCCAAACGCATCTCAGCACATCACGCCGAGCTACAACTACGCGC
CCAACCCGGACAAACACTGGATCATGCGCTACACGGGGCCCATGAAGCCCATCCAC
ATGGAATTCACCAACATGCTCCAGCGGAAGCGCTTGCAGACCCTCATGTCGGTGGA
CGACTCCATGGAGACGATTTACAACATGCTGGTTGAGACGGGCGAGCTGGACAACA
CGTACATCGTATACACCGCCGACCACGGTTACCACATCGGCCAGTTTGGCCTGGTG
AAAGGGAAATCCATGCCATATGAGTTTGACATCAGGGTCCCGTTCTACGTGAGGGGC
CCCAACGTGGAAGCCGGCTGTCTGAATCCCCACATCGTCCTCAACATTGACCTGGC
CCCCACCATCCTGGACATTGCAGGCCTGGACATACCTGCGGATATGGACGGGAAAT
CCATCCTCAAGCTGCTGGACACGGAGCGGCCGGTGAATCGGTTTCACTTGAAAAAG
AAGATGAGGGTCTGGCGGGACTCCTTCTTGGTGGAGAGAGGCAAGCTGCTACACA
AGAGAGACAATGACAAGGTGGACGCCCAGGAGGAGAACTTTCTGCCCAAGTACCA
GCGTGTGAAGGACCTGTGTCAGCGTGCTGAGTACCAGACGGCGTGTGAGCAGCTG
GGACAGAAGTGGCAGTGTGTGGAGGACGCCACGGGGAAGCTGAAGCTGCATAAGT
GCAAGGGCCCCATGCGGCTGGGCGGCAGCAGAGCCCTCTCCAACCTCGTGCCCA
AGTACTACGGGCAGGGCAGCGAGGCCTGCACCTGTGACAGCGGGGACTACAAGCT
CAGCCTGGCCGGACGCCGGAAAAAACTCTTCAAGAAGAAGTACAAGGCCAGCTATG
TCCGCAGTCGCTCCATCCGCTCAGTGGCCATCGAGGTGGACGGCAGGGTGTACCA
CGTAGGCCTGGGTGATGCCGCCCAGCCCCGAAACCTCACCAAGCGGCACTGGCCA
GGGGCCCCTGAGGACCAAGATGACAAGGATGGTGGGGACTTCAGTGGCACTGGAG
GCCTTCCCGACTACTCAGCCGCCAACCCCATTAAAGTGACACATCGGTGCTACATCC
TAGAGAACGACACAGTCCAGTGTGACCTGGACCTGTACAAGTCCCTGCAGGCCTGG
AAAGACCACAAGCTGCACATCGACCACGAGATTGAAACCCTGCAGAACAAAATTAAG
AACCTGAGGGAAGTCCGAGGTCACCTGAAGAAAAGCGGCCAGAAGAATGTGACT
GTCACAAAATCAGCTACCACACCCAGCACAAAGGCCGCCTCAAGCACAGAGGCTCC
AGTCTGCATCCTTTCAGGAAGGGCCTGCAAGAGAAGGACAAGGTGTGGCTGTTGC
GGGAGCAGAAGCGCAAGAAGAAACTCCGCAAGCTGCTCAAGCGCCTGCAGAACAA

FIG. 10A

CGACACGTGCAGCATGCCAGGCCTCACGTGCTTCACCCACGACAACCAGCACTGG
CAGACGGCGCCTTTCTGGACACTGGGGCCTTTCTGTGCCTGCACCAGCGCCAACA
ATAACACGTACTGGTGCATGAGGACCATCAATGAGACTCACAATTTCCTCTTCTGTG
AATTTGCAACTGGCTTCCTAGAGTACTTTGATCTCAACACAGACCCCTACCAGCTGA
TGAATGCAGTGAACACACTGGACAGGGATGTCCTCAACCAGCTACACGTACAGCTC
ATGGAGCTGAGGAGCTGCAAGGGTTACAAGCAGTGTAACCCCCGGACTCGAAACA
TGGACCTGGGACTTAAAGATGGAGGAAGCTATGAGCAATACAGGCAGTTTCAGCGT
CGAAAGTGGCCAGAAATGAAGAGACCTTCTTCCAAATCACTGGGACAACTGTGGG
AAGGCTGGGAAGGTTAAgaaacaacagaggtggacctccaaaaacatagaggcatcacctgactgcacag
gcaatgaaaaaccatgtgggtgatttccagcagacctgtgctattggccaggaggcctgagaaagcaagcacgcactct
cagtcaacatgacagattctggaggataaccagcaggagcagagataacttcaggaagtccattttgcccctgcttttgct
ttggattatacctcaccagctgcacaaaatgcattttttcgtatcaaaaagtcaccactaaccctcccccagaagctcacaa
aggaaaacggagagagcgagcgagagagatttccttggaaatttctcccaagggcgaaagtcattggaattttttaaatca
tagggaaaagcagtcctgttctaaatcctcttattcttttggtttgtcacaaagaaggaactaagaagcaggacagaggc
aacgtggagaggctgaaaacagtgcagagacgtttgacaatgagtcagtagcacaaaagagatgacatttacctagca
tataaaccctggttgcctctgaagaaactgccttcattgtatatatgtgactatttacatgtaatcaacatgggaactttaggggg
aacctaataagaaatcccaattttcaggagtggtggtgtcaataaacgctctgtggccagtgtaaaagaaaaaaaaaaa
aaattgtggacatttctgttcctgtccagataccatttctcctagtatttctttgttatgtcccagaactgatgttttttttttaaggtact
gaaaagaaatgaagttgatgtatgtcccaagttttgatgaaactgtatttgtaaaaaaaattttgtagtttaagtattgtcataca
gtgttcaaaaccccagccaatgaccagcagttggtatgaagaacctttgacattttgtaaaaggccatttcttggggaaaaa
aaaaaaaaaaaaaaaaaaaaaaaaaaaaaaaaaa

FIG. 10B

>human SULF2 protein (translation of ORF)
MGPPSLVLCLLSATVFSLLGGSSAFLSHHRLKGRFQRDRRNIRPNIILVLTDDQDVELGS
MQVMNKTRRIMEQGGAHFINAFVTTPMCCPSRSSILTGKYVHNHNTYTNNENCSSPSW
QAQHESRTFAVYLNSTGYRTAFFGKYLNEYNGSYVPPGWKEWVGLLKNSRFYNYTLCR
NGVKEKHGSDYSKDYLTDLITNDSVSFFRTSKKMYPHRPVLMVISHAAPHGPEDSAPQY
SRLFPNASQHITPSYNYAPNPDKHWIMRYTGPMKPIHMEFTNMLQRKRLQTLMSVDDS
METIYNMLVETGELDNTYIVYTADHGYHIGQFGLVKGKSMPYEFDIRVPFYVRGPNVEAG
CLNPHIVLNIDLAPTILDIAGLDIPADMDGKSILKLLDTERPVNRFHLKKKMRVWRDSFLVE
RGKLLHKRDNDKVDAQEENFLPKYQRVKDLCQRAEYQTACEQLGQKWQCVEDATGKL
KLHKCKGPMRLGGSRALSNLVPKYYGQGSEACTCDSGDYKLSLAGRRKKLFKKKYKAS
YVRSRSIRSVAIEVDGRVYHVGLGDAAQPRNLTKRHWPGAPEDQDDKDGGDFSGTGG
LPDYSAANPIKVTHRCYILENDTVQCDLDLYKSLQAWKDHKLHIDHEIETLQNKIKNLREV
RGHLKKKRPEECDCHKISYHTQHKGRLKHRGSSLHPFRKGLQEKDKVWLLREQKRKK
KLRKLLKRLQNNDTCSMPGLTCFTHDNQHWQTAPFWTLGPFCACTSANNNTYWCMRT
INETHNFLFCEFATGFLEYFDLNTDPYQLMNAVNTLDRDVLNQLHVQLMELRSCKGYKQ
CNPRTRNMDLGLKDGGSYEQYRQFQRRKWPEMKRPSSKSLGQLWEGWEG

FIG. 10C

>mouse SULF2 full length cDNA (ORF highlighted in capitals)
ggcggcggagatcctgagggaagaggggaaggaatcccatcctcacgacaccacctcggcctctgcatccaggaagaa
gcaaaggaccagcaagccacgccaATGGCACCCCTGGCCTGCCACTATGGCTGCTGTCCAC
CGCTCTCCTCTCCCTGCTGGCTGGCAGCTCGGCCTTCCTCTCCCATCCCCGCCTGA
AGGGACGCTTCCAGAGGGACCGCAGGAACATCCGGCCCAACATCATCTTGGTGCTT
ACGGATGACCAGGATGTGGAGCTGGGCTCCATGCAAGTGATGAACAAGACAAGGCG
TATCATGGAGCAGGGCGGGGCGCACTTCATCAATGCCTTCGTGACTACACCAATGTG
CTGTCCGTCTCGCTCCTCCATTCTCACCGGCAAGTACGTCCACAACCACAACACCTA
CACCAACAATGAGAATTGTTCCTCGCCCTCCTGGCAGGCCCAGCACGAGAGCCGCA
CCTTCGCCGTGTATCTCAACAGCACAGGCTACCGGACAGCTTTCTTCGGAAAATACCT
CAATGAGTACAACGGCTCATACGTGCCGCCCGGCTGGAAGGAGTGGGTCGGCCTAC
TTAAGAACTCCCGCTTTTATAACTACACACTCTGCCGGAATGGGGTGAAGGAGAAACA
TGGCTCGGACTACTCCACGGATTACCTCACGGATCTCATCACCAATGACAGTGTGAG
CTTCTTCCGAACATCCAAGAAGATGTACCCACACAGGCCCGTGCTCATGGTCATCAG
CCACGCGGCTCCCCATGGCCCCGAGGACTCAGCACCCAGTACTCACGGCTCTTCC
CCAATGCGTCCCAGCACATCACACCGAGTTACAACTATGCACCCAACCCAGACAAGC
ATTGGATCATGCGCTACACGGGACCCATGAAGCCCATTCACATGGAATTCACCAACAT
GCTACAACGAAAACGCCTACAGACCCTCATGTCTGTGGATGACTCCATGGAGACGAT
CTATGACATGCTGGTGGAGACGGGGGAGCTGGACAACACGTACATCCTGTACACCGC
CGACCACGGCTACCACATTGGCCAGTTTGGCTGGTGAAGGGCAAGTCTATGCCGTA
TGAATTCGACATCAGAGTCCCGTTCTACGTGAGGGGCCCCAACGTGGAAGCTGGCT
CTCTGAACCCCCACATTGTCCTCAACATTGACCTGGCCCCCACCATACTGGATATCGC
TGGACTGGACATCCCTGCAGACATGGACGGGAAGTCTATTCTCAAACTACTGGACTC
AGAGCGGCCAGTGAACCGGTTCCACTTGAAAAAGAAGCTGAGGGTCTGGCGAGACT
CCTTCCTGGTGGAGAGAGGCAAACTGCTCCACAAGAGGGAGGGTGACAAAGTGAAT
GCCCAGGAGGAGAACTTCCTGCCCAAGTACCAGCGCGTGAAGGACCTGTGTCAGCG
AGCTGAGTACCAGACAGCATGCGAACAGCTGGGGCAGAAGTGGCAGTGTGTGGAGG
ACGCTTCTGGGACGCTGAAGCTGCACAAATGTAAAGGCCCCATGCGGTTTGGTGGC
GGCGGTGGCAGCAGAGCCCTCTCCAACCTGGTGCCCAAGTATGACGGCCAGAGCA
GCGAGGCCTGCAGCTGTGACAGTGGCGGTGGAGGGGACTACAAACTGGGCCTGGC
TGGACGCCGTAAGCTCTTTAAGAAAAAGTATAAGACCAGCTATGCCCGGAACCGCTC
CATCCGTTCCGTGGCCATCGAGGTGGACGGTGAGATATACCACGTAGGCTTGGATAC
TGTACCTCAGCCCCGCAACCTTAGCAAGCCGCACTGGCCAGGGGCCCCTGAAGACC
AAGATGACAAGGATGGTGGCAGTTTCAGTGGTACTGGTGGCCTTCCAGATTATTCTGC
CCCCAATCCCATCAAAGTGACCCATCGGTGCTACATCCTTGAGAATGACACAGTCCAG
TGCGACTTGGACCTGTACAAGTCCCTGCAGGCTTGGAAAGACCACAAGCTGCACATC
GACCATGAGATCGAAACCCTGCAGAACAAAATTAAGAACCTTCGAGAAGTCAGGGGT
CACCTGAAGAAGAAGCGACCGGAAGAATGTGACTGCCATAAAATCAGTTACCACAGC
CAACACAAAGGCCGTCTCAAGCACAAAGGCTCCAGCCTGCACCCTTTCAGGAAGGG
TCTGCAGGAGAAGGACAAGGTGTGGCTGCTGCGGGAGCAGAAACGCAAGAAGAAA
CTGCGCAAGCTGCTCAAACGGCTGCAGAACAACGATACGTGCAGCATGCCCGGCCT
CACGTGCTTTACCCACGACAACCACCACTGGCAGACGGCGCCACTCTGGACGCTGG
GGCCGTTCTGCGCCTGCACCAGCGCCAACAACAACACGTACTGGTGCTTGAGGACC
ATAAATGAGACCCACAACTTCCTCTTCTGCGAATTTGCAACCGGCTTCATAGAATACTT
TGACCTCAGTACAGACCCCTACCAGCTGATGAACGCGGTGAACACACTGGACAGGG
ACGTCCTTAACCAACTGCACGTGCAGCTCATGGAGCTAAGGAGCTGTAAAGGCTACA
AGCAGTGCAACCCCCGGACCCGCAACATGGACCTGGGGCTTAGAGACGGAGGAAG
CTATGAACAATACAGGCAGTTTCAGCGTCGAAAATGGCCAGAAATGAAGAGACCTTCT
TCCAAATCACTGGGACAGCTATGGGAAGGTTGGGAAGGCTAAgcggccatagagagaggaac

FIG. 11A

```
ctccaaaaccaggggcctcgtgtggctgcccaggccatgcaaaaaacacccgattcccagaagatgaatgttggaact
gggagacctgacagaaggcagggcctgctcttgggacaggaaatcctggaggacagcgcctggactttccgatgctca
gtttctttgccctgctttgctctggatcaaacctcactggctgctctgggatgcgtgctcacacctggagtctctgctcacccttc
agaggctcacaaagacaaaggaactaatttccatggacacttcctccagagatggaaattgctgggattcgcccactcct
cccctgcacccctcccccagtcatctagggaagcaagcttgttttaaccttcttactctttggagaaagcacggacatccca
ggtgctgtcaacctcacagtcttgacaaagtctatagcacaaaacagtaccattcaccaggctggttgacctggctggctc
agaagctgccttcaccacatacatgaccgctcacacgtaaccaacacagggaattgtaggggaatctcactaatatgaa
atcccgcttttcaagagtcgcggtgtcaataaacgctgtggctaggatcaaggataatcccttgagctttcagacatttattcct
gcccgggattcgttcctttgttatccatcccagaactgatgttttctaaggtaccgaaaccccaagttgatgtgtgtcctgtgtttt
aatgacattgtatttgtaaagttttgtagtataagtaccatcttacagtgttcctgcccccagccaatgtctagctattggtatgaa
aaaaaaatctttgaattttgtaaaaaaaaaaaaaaaaa
```

FIG. 11B

>mouse SULF2 protein (translation of ORF)
MAPPGLPLWLLSTALLSLLAGSSAFLSHPRLKGRFQRDRRNIRPNIILVLTDDQDVELG
SMQVMNKTRRIMEQGGAHFINAFVTTPMCCPSRSSILTGKYVHNHNTYTNNENCSS
PSWQAQHESRTFAVYLNSTGYRTAFFGKYLNEYNGSYVPPGWKEWVGLLKNSRFY
NYTLCRNGVKEKHGSDYSTDYLTDLITNDSVSFFRTSKKMYPHRPVLMVISHAAPHG
PEDSAPQYSRLFPNASQHITPSYNYAPNPDKHWIMRYTGPMKPIHMEFTNMLQRKR
LQTLMSVDDSMETIYDMLVETGELDNTYILYTADHGYHIGQFGLVKGKSMPYEFDIRV
PFYVRGPNVEAGSLNPHIVLNIDLAPTILDIAGLDIPADMDGKSILKLLDSERPVNRFHL
KKKLRVWRDSFLVERGKLLHKREGDKVNAQEENFLPKYQRVKDLCQRAEYQTACE
QLGQKWQCVEDASGTLKLHKCKGPMRFGGGGGSRALSNLVPKYDGQSSEACSCD
SGGGGDYKLGLAGRRKLFKKKYKTSYARNRSIRSVAIEVDGEIYHVGLDTVPQPRNL
SKPHWPGAPEDQDDKDGGSFSGTGGLPDYSAPNPIKVTHRCYILENDTVQCDLDLY
KSLQAWKDHKLHIDHEIETLQNKIKNLREVGHLKKKRPEECDCHKISYHSQHKGRL
KHKGSSLHPFRKGLQEKDKVWLLREQKRKKKLRKLLKRLQNNDTCSMPGLTCFTHD
NHHWQTAPLWTLGPFCACTSANNNTYWCLRTINETHNFLFCEFATGFIEYFDLSTDP
YQLMNAVNTLDRDVLNQLHVQLMELRSCKGYKQCNPRTRNMDLGLRDGGSYEQYR
QFQRRKWPEMKRPSSKSLGQLWEGWEG

Genomic Organization of huSULF2 gene
numbers represent base pairs

| Contig | exon | start | end | length | gap |
|---|---|---|---|---|---|
| I<br>159532 | 1 | 66100 | 66668 | 568 | |
| | | | | | 28587 |
| | 2 | 95255 | 95529 | 274 | |
| | | | | | 20271 |
| | 3 | 115800 | 116039 | 239 | |
| | | | | | 34042 |
| | 4 | 150081 | 150232 | 151 | |

>13577

| Contig | exon | start | end | length | gap |
|---|---|---|---|---|---|
| II<br>2152 | 5 | 1508 | 1677 | 169 | |

>5146

| Contig | exon | start | end | length | gap |
|---|---|---|---|---|---|
| III<br>17546 | 6 | 4672 | 4822 | 150 | |
| | | | | | 1266 |
| | 7 | 6088 | 6263 | 175 | |
| | | | | | 4190 |
| | 8 | 10453 | 10581 | 128 | |
| | | | | | 1543 |
| | 9 | 12124 | 12180 | 56 | |
| | | | | | 455 |
| | 10 | 12635 | 12764 | 129 | |
| | | | | | 4101 |
| | 11 | 16865 | 17060 | 195 | |

>4971

| Contig | exon | start | end | length | gap |
|---|---|---|---|---|---|
| IV<br>87036 | 12 | 4486 | 4714 | 228 | |
| | | | | | 308 |
| | 13 | 5022 | 5118 | 96 | |
| | | | | | 564 |
| | 14 | 5682 | 5776 | 94 | |
| | | | | | 1010 |
| | 15 | 6786 | 6845 | 59 | |
| | | | | | 508 |
| | 16 | 7353 | 7522 | 169 | |
| | | | | | 241 |
| | 17 | 7763 | 7905 | 142 | |
| | | | | | 1225 |
| | 18 | 9130 | 9253 | 123 | |
| | | | | | 2043 |
| | 19 | 11296 | 11329 | 33 | |
| | | | | | 245 |
| | 20 | 11574 | 11627 | 53 | |
| | | | | | 1007 |
| | 21 | 12634 | 13620 | 986 | |

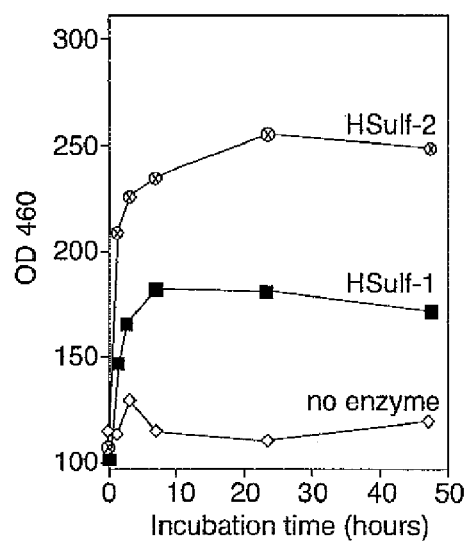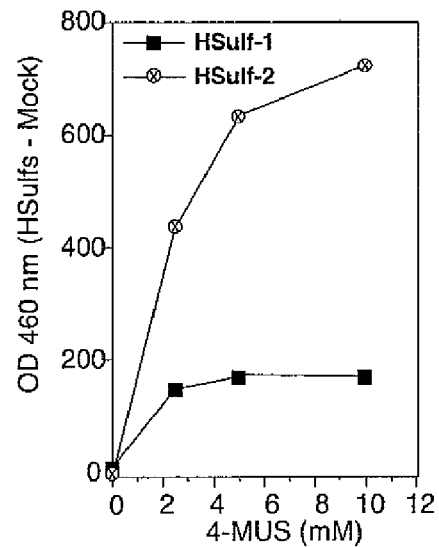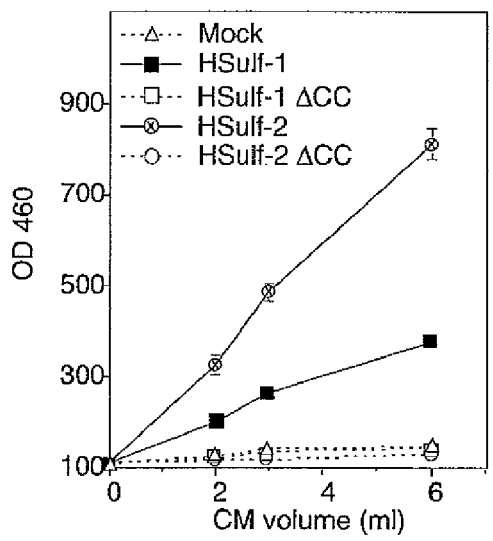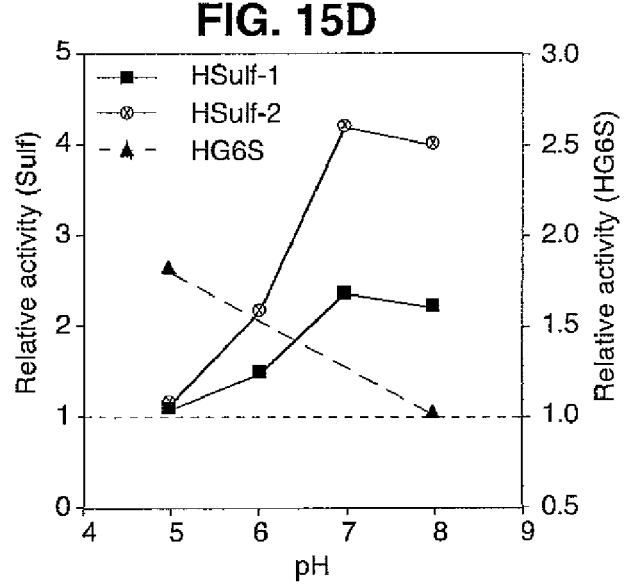

SULFATASES AND METHODS OF USE THEREOF

CROSS-REFERENCE

This application is a continuation-in-part of U.S. patent application Ser. No. 10/265,071, filed Oct. 3, 2002, which is a continuation-in-part of U.S. patent application Ser. No. 10/025,966, filed Dec. 21, 2001, which claims the benefit of U.S. Provisional Patent Application No. 60/258,577, filed Dec. 27, 2000, and U.S. Provisional Patent Application No. 60/267,831, filed Feb. 9, 2001, which applications are incorporated herein by reference in their entirety.

STATEMENT REGARDING FEDERALLY SPONSORED RESEARCH

This invention was made with Government support under Grant No. GM23547, awarded by the National Institutes of Health. The United States Government has certain rights in this invention.

FIELD OF THE INVENTION

The present invention is in the field of sulfatase enzymes.

SEQUENCE LISTING

The present specification incorporates herein by reference, each in its entirety, the sequence information on the Compact Disks (CDs) labeled Copy 1 and Copy 2. The CDs are formatted on IBM-PC, with operating system compatibility with MS-Windows. The files on each of the CDs are as follows:
Copy 1—Seqlist.txt 932 KB created Sep. 2, 2005; and
Copy 2—Seqlist.txt 932 KB created Sep. 2, 2005.

BACKGROUND OF THE INVENTION

Sulfatase enzymes are involved in a variety of physiological processes, including development, metabolism, and inflammation. For example, the developmental signaling functions of cell surface heparan sulfate proteoglycans (HSPGs) are dependent on their sulfation states. Human lysosomal arylsulfatase A is a prototype member of the sulfatase family. Glucosamine-6-sulphatase is an exo-hydrolase required for the lysosomal degradation of heparan sulphate and keratan sulphate. These enzymes require the posttranslational oxidation of the —$CH_2SH$ group of a conserved cysteine to an aldehyde, yielding a formylglycine. Without this modification sulfatases are catalytically inactive, as revealed by a lysosomal storage disorder known as multiple sulfatase deficiency. For example, deficiency of glucosamine-6-sulphatase activity leads to the lysosomal storage of the glycosaminoglycan, heparan sulphate and the monosaccharide sulphate N-acetylglucosamine 6-sulphate and the autosomal recessive genetic disorder mucopolysaccharidosis type IIID.

Others have isolated and identified a glycosulfatase that removes the sulfate moiety from mucous glycoprotein. Further, others have isolated and specifically identified human glucosamine-6-sulfatase and obtained cDNA coding for such. Finally, others isolated and specifically identified N-acetylgalactosamine-6-sulfate/galactose-6-sulfate sulfatase.

Angiogenesis and vasculogenesis are processes involved in the growth of blood vessels. Angiogenesis is the process by which new blood vessels are formed from extant capillaries, while vasculogenesis involves the growth of vessels deriving from endothelial progenitor cells. Angiogenesis and vasculogenesis, and the factors that regulate these processes, are important in embryonic development, inflammation, and wound healing. However, angiogenesis and vasculogenesis also contribute to pathologic conditions such as tumor growth, diabetic retinopathy, rheumatoid arthritis, and chronic inflammatory diseases (see, e.g., U.S. Pat. No. 5,318, 957; Yancopoulos et al. (1998) *Cell* 93:661-4; Folkman et al (1996) *Cell* 87, 1153-5; and Hanahan et al. (1996) *Cell* 86:353-64). For example, generation of new blood vessels in the vicinity of a tumor allows the tumor to grow and, in come cases, metastasize.

Several angiogenic and/or vasculogenic agents with different properties and mechanisms of action are well known in the art. For example, acidic and basic fibroblast growth factor (FGF), transforming growth factor alpha (TGF-α) and beta (TGF-β), tumor necrosis factor (TNF), platelet-derived growth factor (PDGF), vascular endothelial cell growth factor (VEGF), and angiogenin are potent and well-characterized angiogenesis-promoting agents.

Despite the availability of therapies to treat cancer, ischemic conditions, and inflammation, a need exists for additional ways to combat these disorders. The present invention addresses this need.

Literature

Parenti et al. (1997) *Curr. Opinion Genet. Devel.* 7:386-391; Bergers et al. (2000) *Nature Cell Biol.* 2:737-744; Lukatela et al. (1998) *Biochem.* 37:3654; Knaust et al. (1998) *Biochem.* 37:13941; Robertson et al. (1992) *Biochem J.* 288: 539; Robertson et al. (1993) *Biochem J.* 293:683-689; Robertson et al. (1988) *Biochem. Biophys. Res. Commun.*, 157: 218-224; Tomatsu et al. (1991) *Biochem. Biophys. Res. Commun.* 181:677-683; Folkman et al. (1992) *Seminars in Cancer Biology* 3:89-96; Dhoot et al. (2001) *Science* 293: 1663-1666. U.S. Pat. Nos. 5,925,349; and 5,695,752. International Patent Applications WO 98/53071; WO 99/54448; WO 99/63088; WO 00/06086; WO 01/00828; WO 01/02568; WO 01/40269; WO 01/42467; WO 01/59127; WO 01/57058; WO 01/21640; Iacobuzio-Donahue et al. (2003) *Am. J. Pathol* 162:1151-1162; Lie et al. (2005) *Mol. Cancer.* 4:14; Su et al. (2001) *Cancer Res.* 61:7388-7393.

SUMMARY OF THE INVENTION

Novel sulfatases and polypeptides related thereto, as well as nucleic acid compositions encoding the same, are provided. The subject polypeptide and nucleic acid compositions find use in a variety of applications, including diagnostic applications, and therapeutic agent screening applications, as well as in treatment of a variety of disease conditions. Also provided are methods of modulating sulfatase enzymatic activity and methods of treating disease conditions associated therewith, particularly by administering inhibitors of the novel sulfatases.

BRIEF DESCRIPTION OF THE DRAWINGS

FIGS. 1A-1C provide the cDNA sequence (FIGS. 1A and 1B) and amino acid sequence (FIG. 1C) of human SULF1. The full length cDNA sequence is SEQ ID NO:01, the open reading frame is set forth in SEQ ID NO:02, and the amino acid sequence of the protein encoded by the open reading frame is SEQ ID NO:03.

FIGS. 2A-2C provide the cDNA sequence (FIGS. 2A and 2B) and amino acid sequence (FIG. 2C) of human SULF2.

The full length cDNA sequence is SEQ ID NO:04, the open reading frame is set fort in SEQ ID NO:05, and the amino acid sequence of the protein encoded by the open reading frame is SEQ ID NO:06.

FIGS. 3A-3C provide the cDNA sequence (FIGS. 3A and 3B) and amino acid sequence (FIG. 3C) of mouse SULF-1. The full length cDNA sequence is SEQ ID NO:07, the open reading frame is set forth in SEQ ID NO:08, and the amino acid sequence of the protein encoded by the open reading frame is SEQ ID NO:09.

FIGS. 4A-4C provide the cDNA sequence (FIGS. 4A and 4B) and amino acid sequence (FIG. 4C) of mouse SULF-2. The full length cDNA sequence is SEQ ID NO:10, the open reading frame is set forth in SEQ ID NO:11, and the amino acid sequence of the protein encoded by the open reading frame is SEQ ID NO:12.

Figure 5:
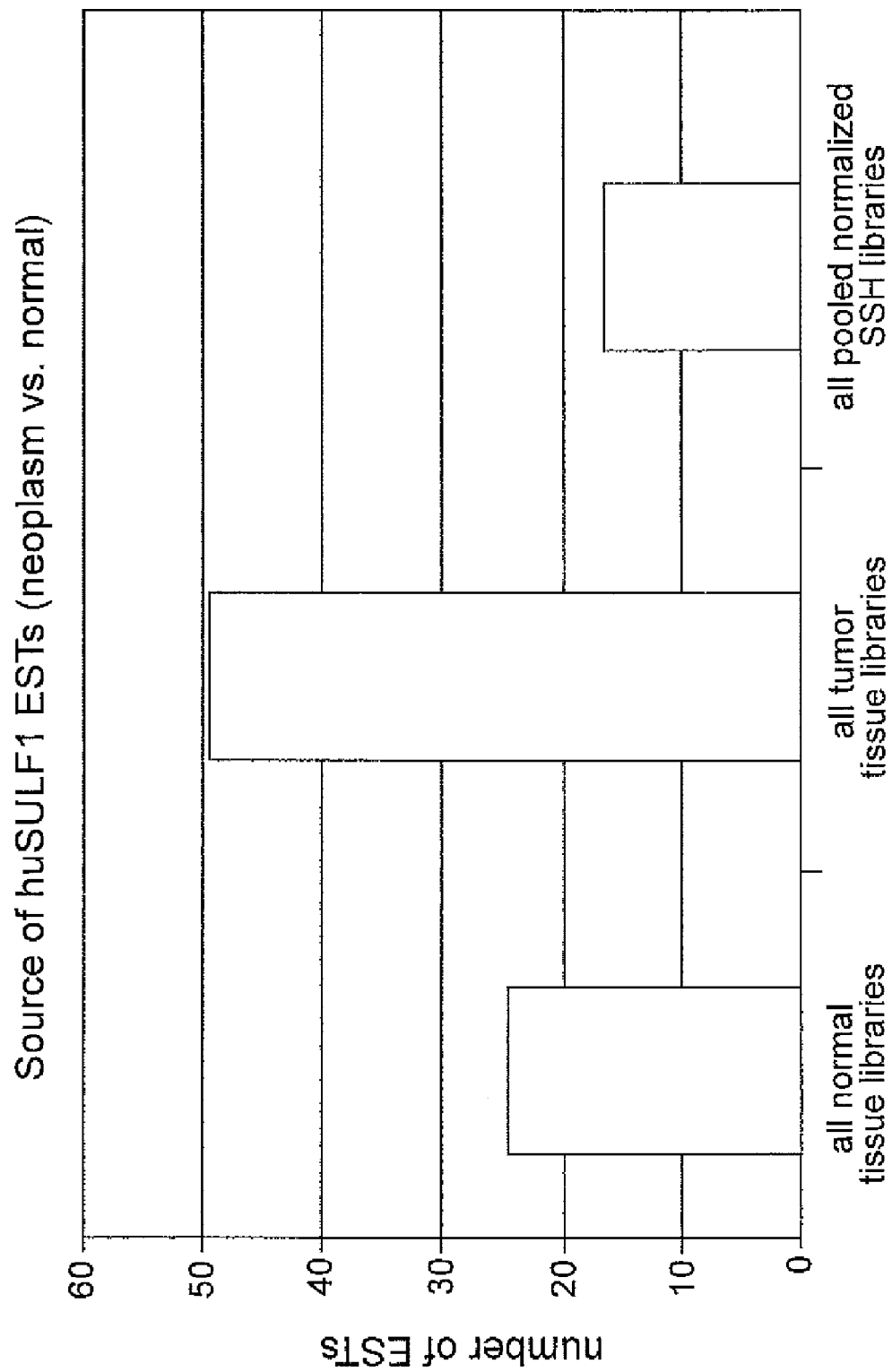

FIG. 5 is a graph depicting the numbers of human SULF1 expressed sequence tags (ESTs) in normal and tumor tissue libraries.

Figure 6:
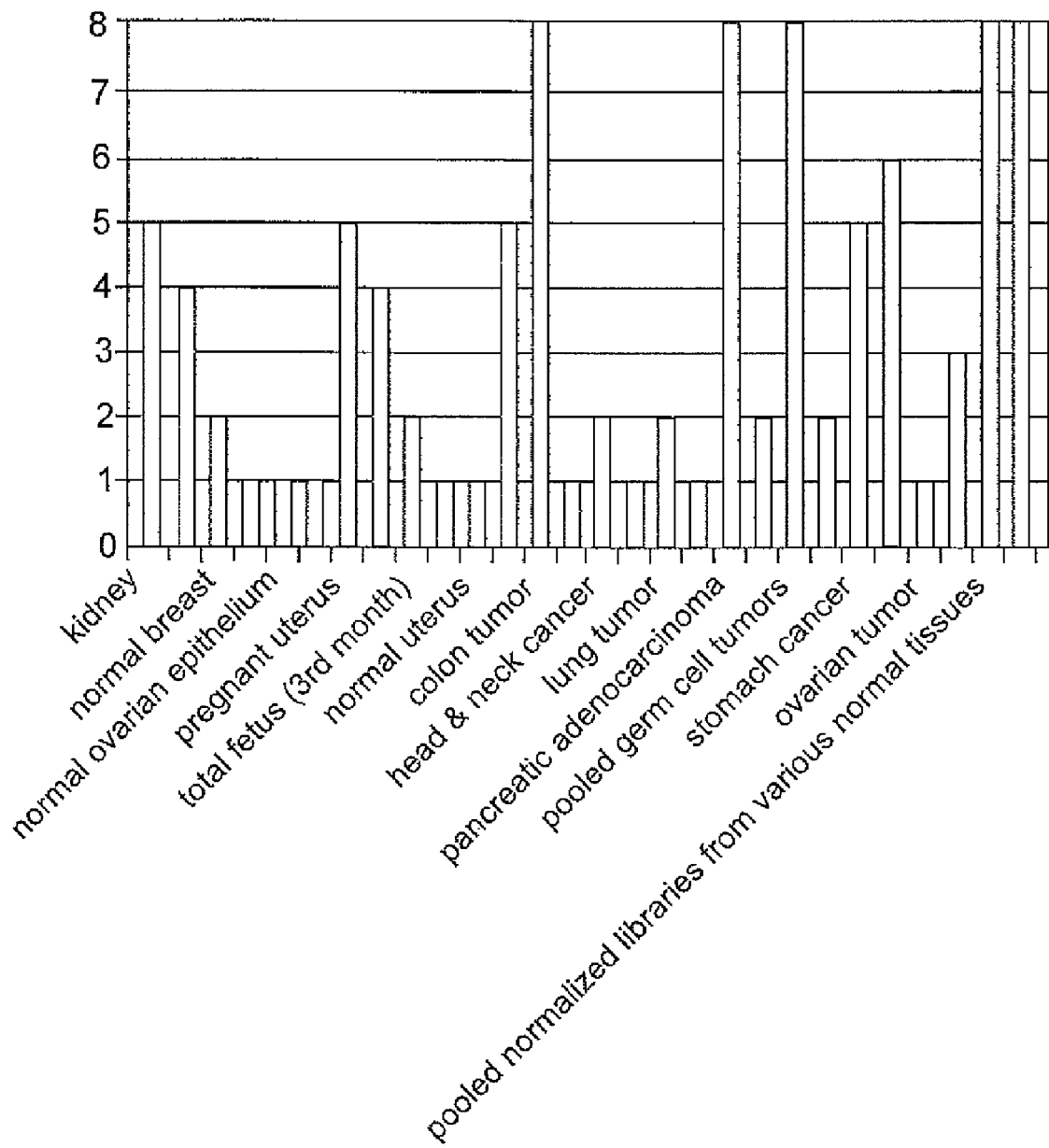

FIG. 6 is a graph depicting the numbers of huSULF1 ESTs in various tissues.

Figure 7:
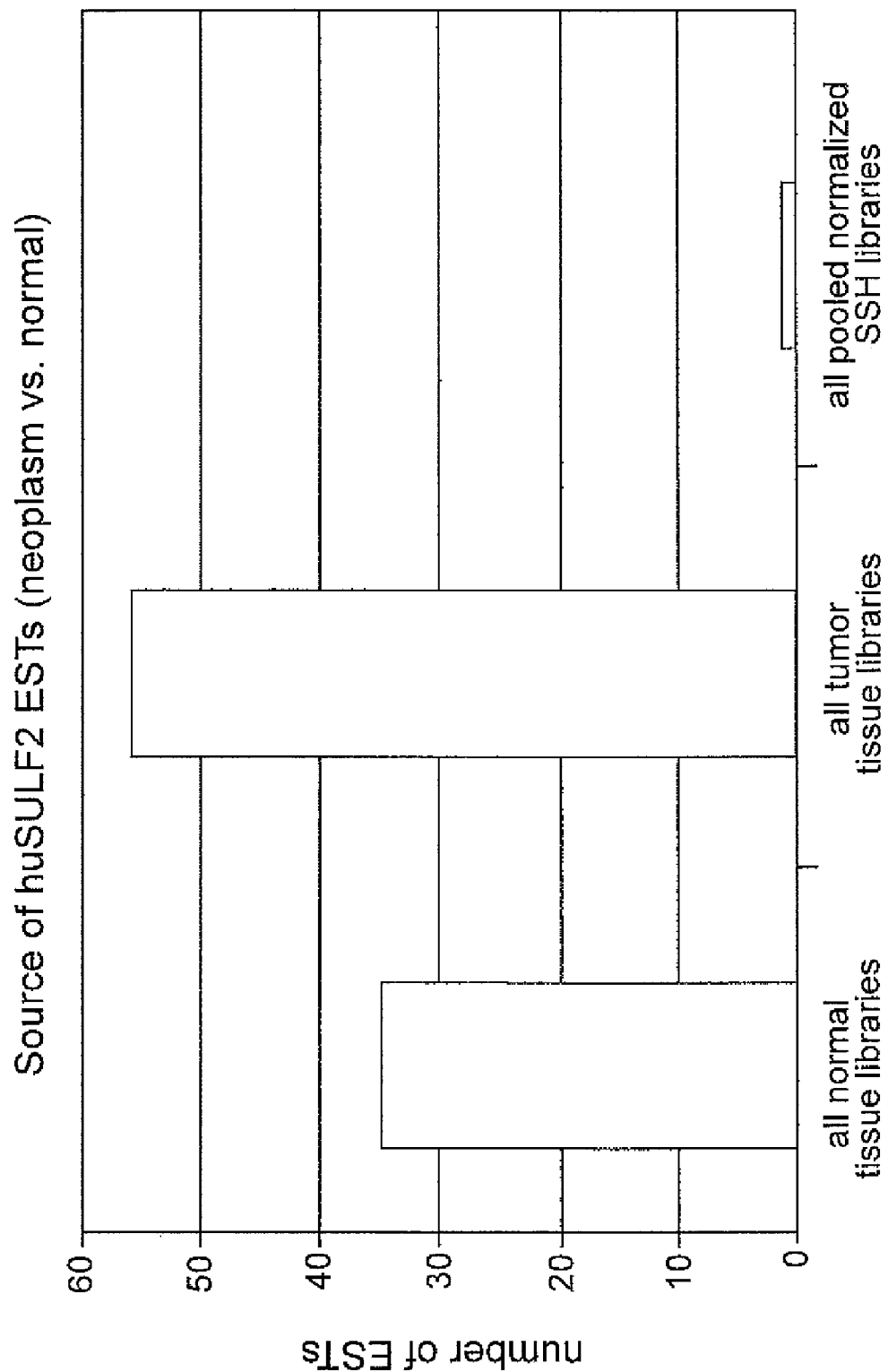

FIG. 7 is a graph depicting the numbers of human SULF2 expressed sequence tags (ESTs) in normal and tumor tissue libraries.

Figure 8:
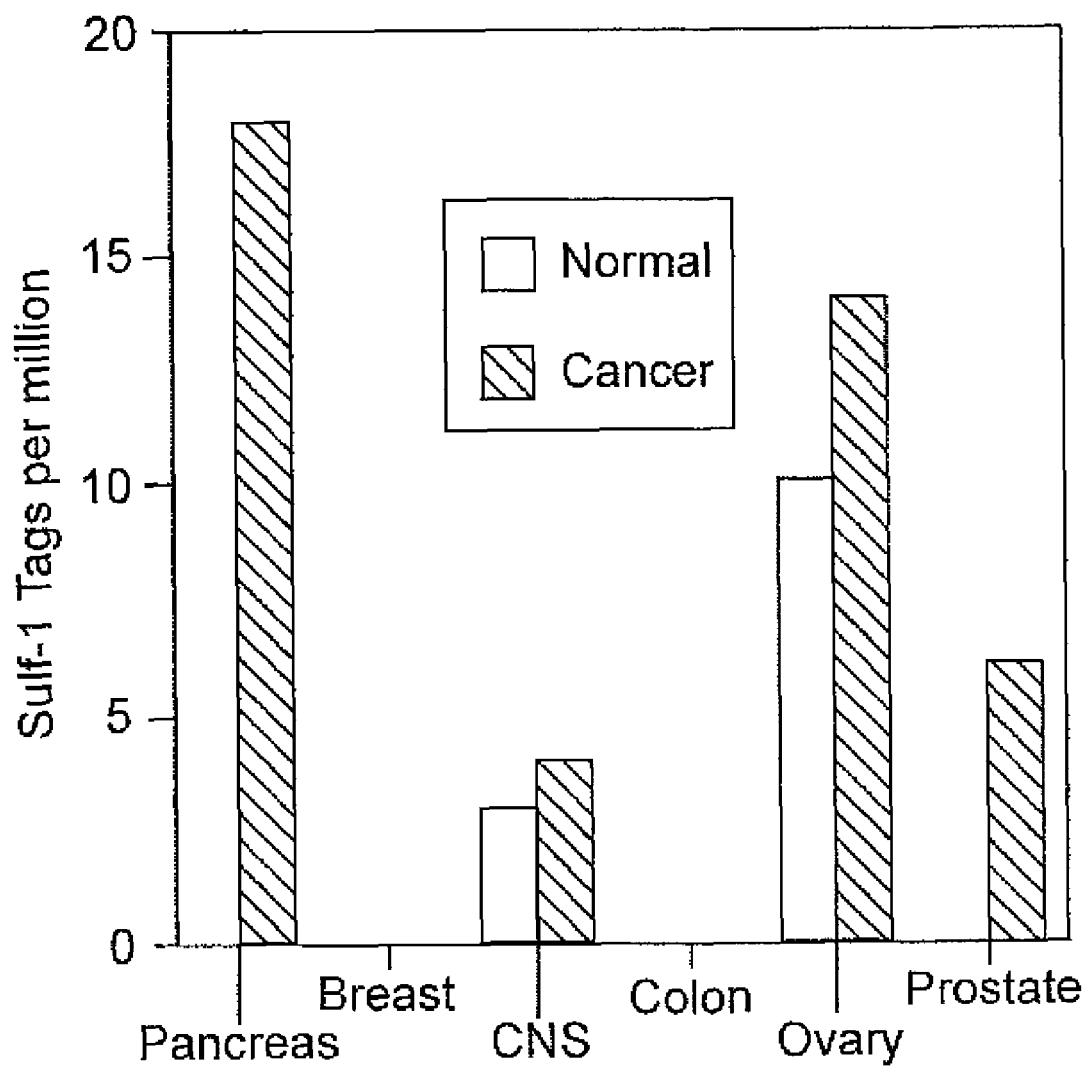

FIG. 8 depicts the results of SAGE analysis of huSULF-1 in normal and cancer tissues.

Figure 9:
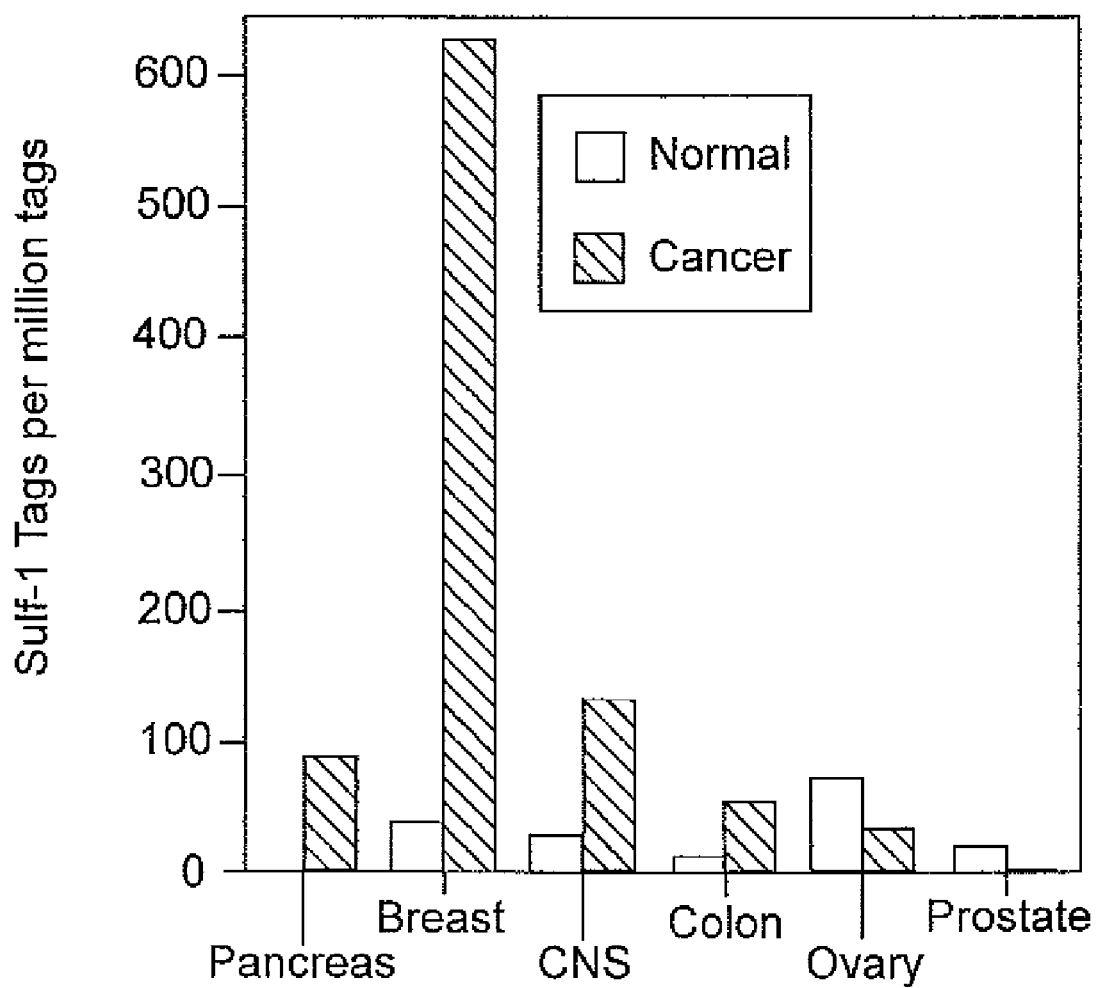

FIG. 9 depicts the results of SAGE analysis of huSULF-2 in normal and cancer tissues.

FIGS. 10A-10C provide the cDNA sequence (FIGS. 10A and 10B) and amino acid sequence (FIG. 10C) of human SULF-2. The full length cDNA sequence is SEQ ID NO:13, the open reading frame is set forth in SEQ ID NO:14, and the amino acid sequence of the protein encoded by the open reading frame is SEQ ID NO:15.

FIGS. 11A-11C provide the cDNA sequence (FIGS. 11A and 11B) and amino acid sequence (FIG. 11C) of mouse SULF-2. The full length cDNA sequence is SEQ ID NO:16, the open reading frame is set forth in SEQ ID NO:17, and the amino acid sequence of the protein encoded by the open reading frame is SEQ ID NO:18.

FIG. 12 depicts exon start and end sites, and exon length for human SULF2 gene exons.

Figure 13:
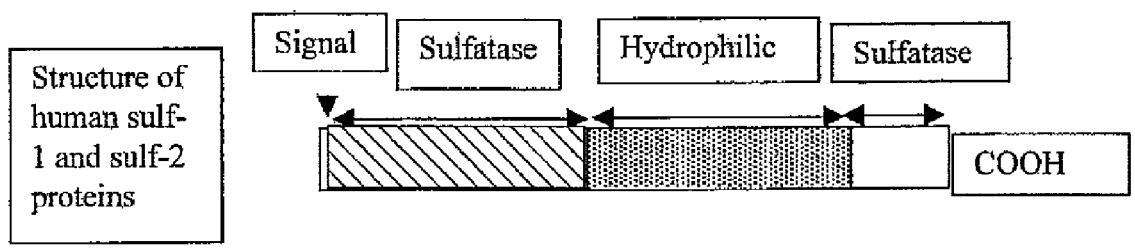

FIG. 13 is a schematic representation of human sulf-1 and sulf-2 protein domain.

Figure 14:
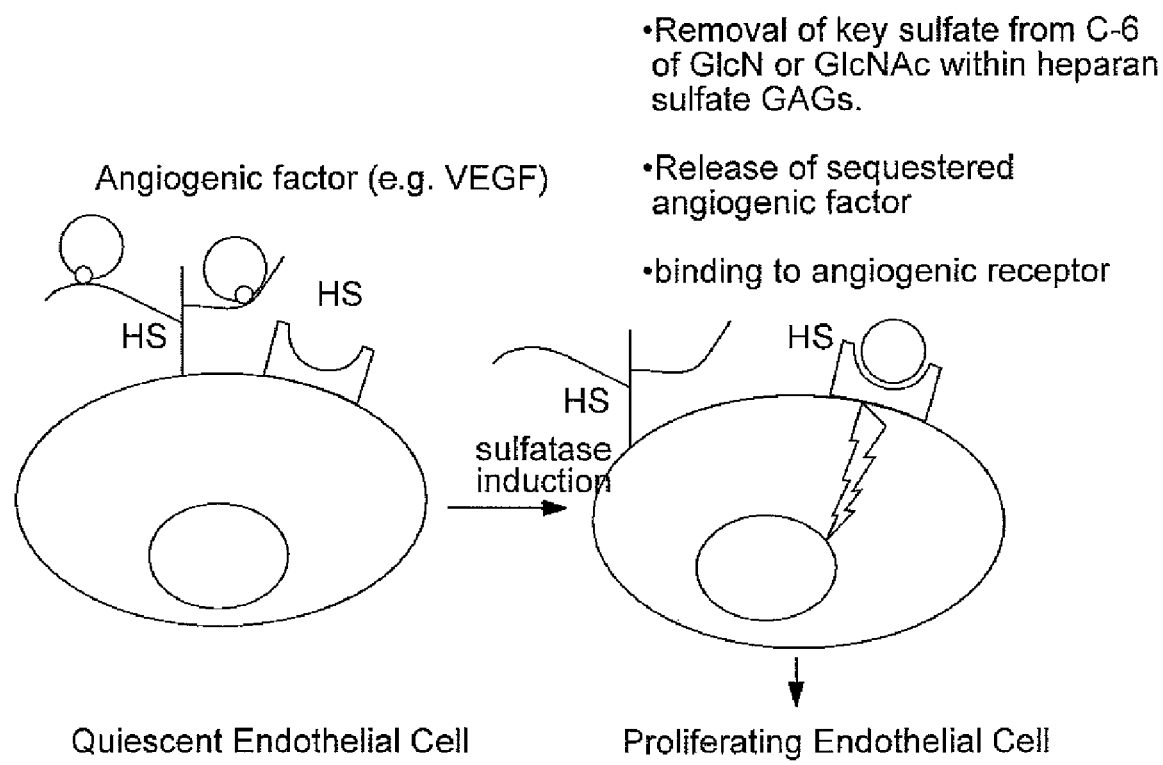

FIG. 14 is a schematic representation of an activity of a subject sulfatase.

FIGS. 15A-D depict arylsulfatase activity of expressed sulfatases, and lack of sulfatase activity in Hsulf mutants.

FIGS. 16A-F depict endo-glucosamine-6-sulfatase activity of expressed sulfatases.

Figure 17:
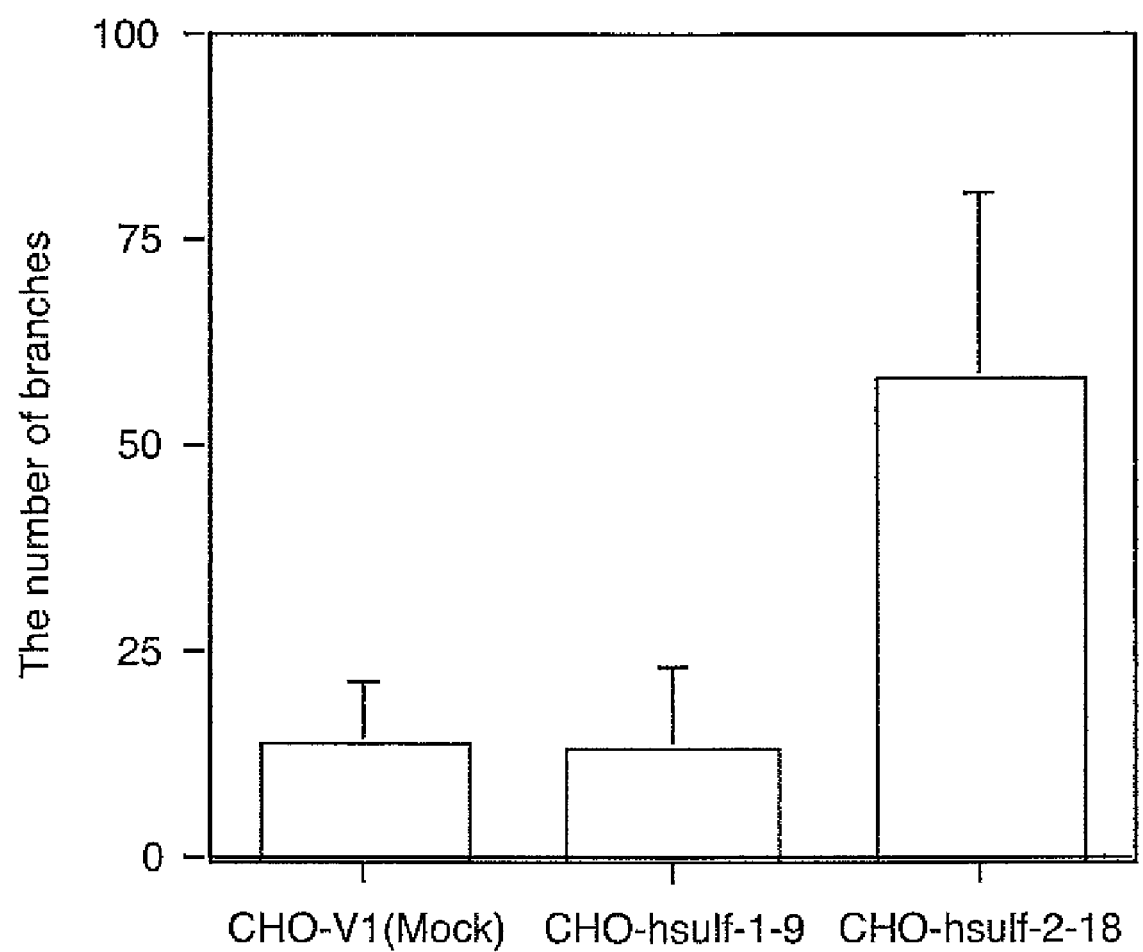

FIG. 17 depicts pro-angiogenic activity of hsulf-2.

Figure 18A:
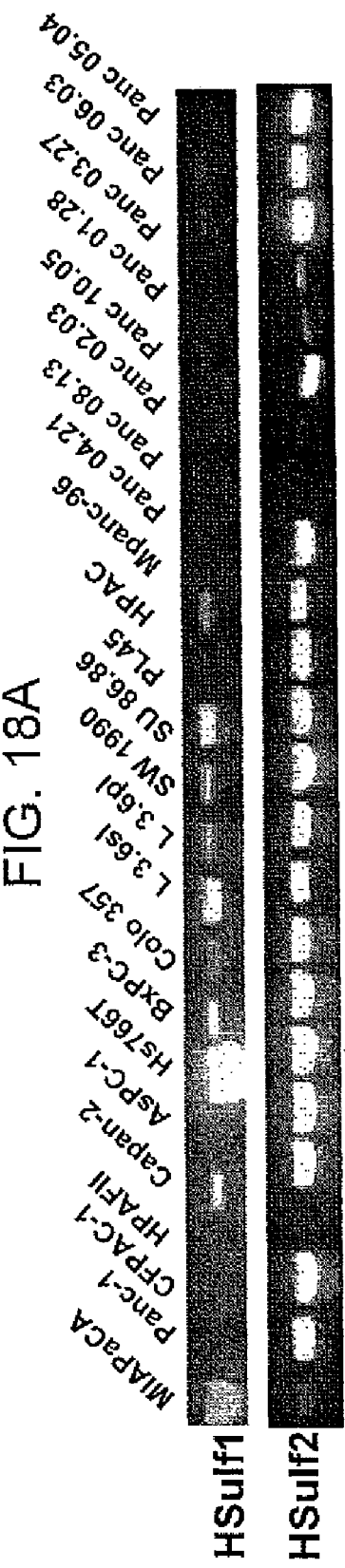
Figure 18B:
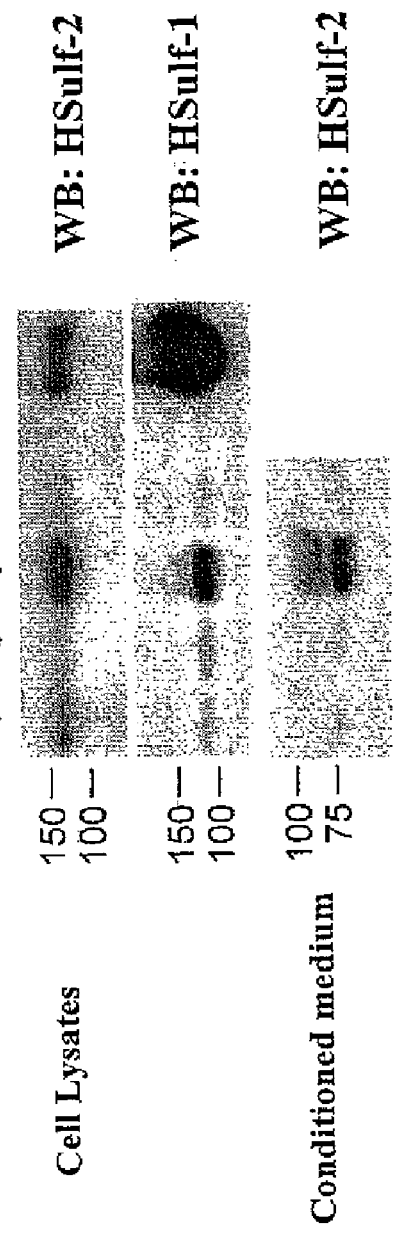
Figure 18C:
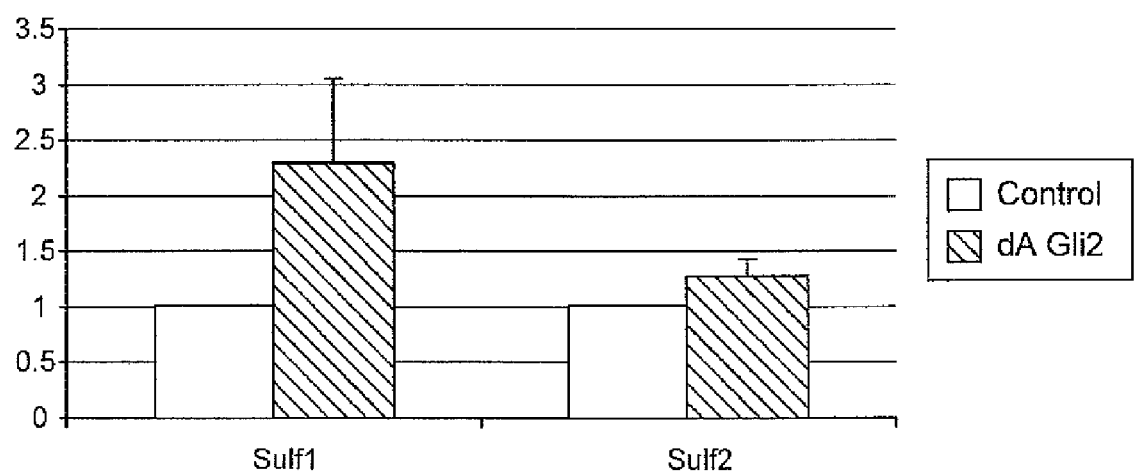

FIGS. 18A-C depict upregulation of HSulf-1 and HSulf-2 in human pancreatic cancer.

FIGS. 19A-D depict the effect of HSulf- and HSulf-2 on Wnt signaling in mammalian cells.

Figure 20A:
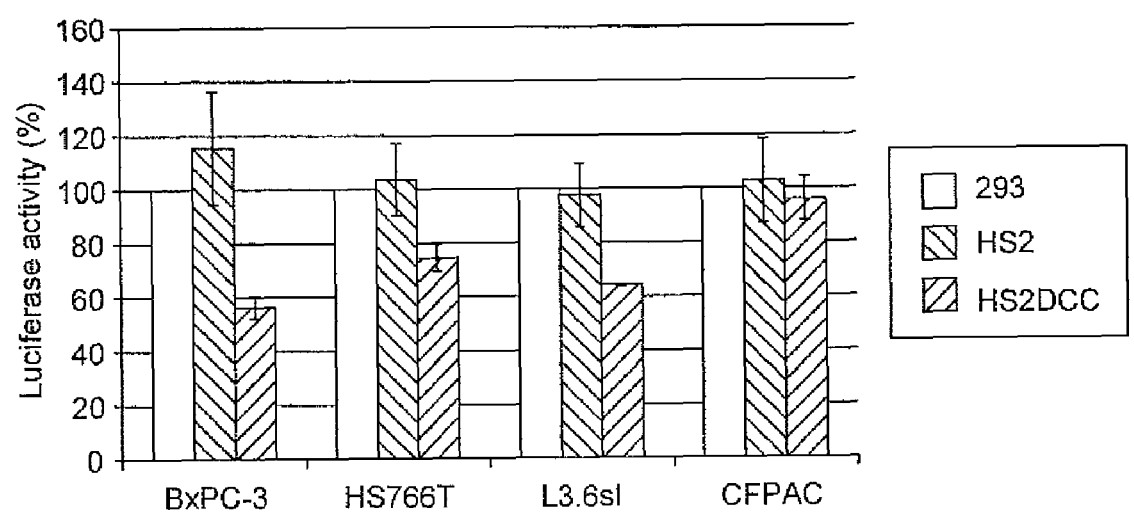
Figure 20B:
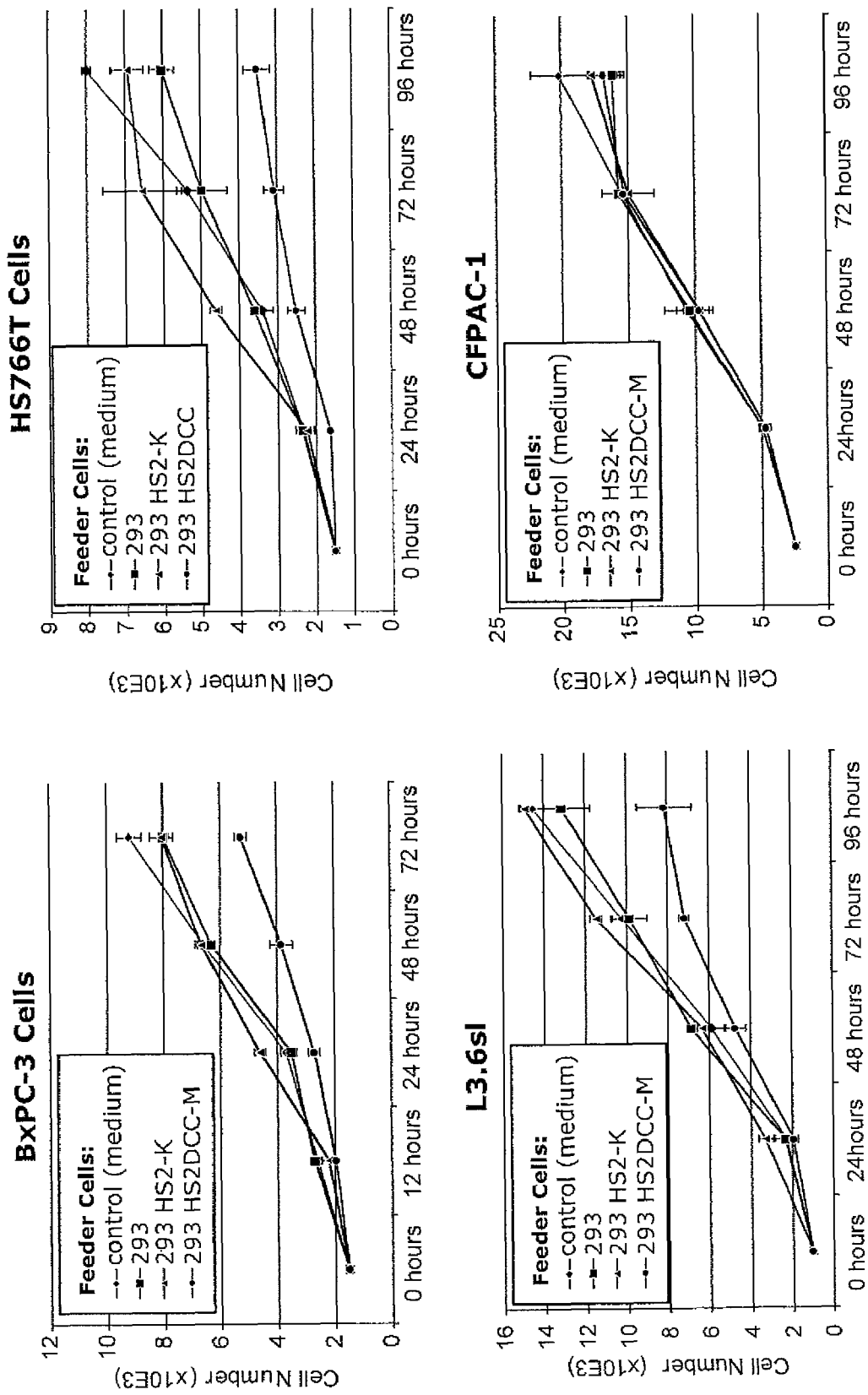

FIGS. 20A and 20B depict the effect of exogenous catalytically inactive human sulfatase protein on Wnt signaling and cell proliferation.

FIGS. 21A-E depict the effect of HSulf-2 silencing on pancreatic adenocarcinoma cell proliferation.

DEFINITIONS

The terms "polynucleotide" and "nucleic acid molecule" are used interchangeably herein to refer to polymeric forms of nucleotides of any length. The polynucleotides may contain deoxyribonucleotides, ribonucleotides, and/or their analogs. Nucleotides may have any three-dimensional structure, and may perform any function, known or unknown. The term "polynucleotide" includes single-, double-stranded and triple helical molecules. "Oligonucleotide" generally refers to polynucleotides of between about 5 and about 100 nucleotides of single- or double-stranded DNA. However, for the purposes of this disclosure, there is no upper limit to the length of an oligonucleotide. Oligonucleotides are also known as oligomers or oligos and may be isolated from genes, or chemically synthesized by methods known in the art.

The following are non-limiting embodiments of polynucleotides: a gene or gene fragment, exons, introns, mRNA, tRNA, rRNA, ribozymes, cDNA, recombinant polynucleotides, branched polynucleotides, plasmids, vectors, isolated DNA of any sequence, isolated RNA of any sequence, nucleic acid probes, and primers. A nucleic acid molecule may also comprise modified nucleic acid molecules, such as methylated nucleic acid molecules and nucleic acid molecule analogs. Analogs of purines and pyrimidines are known in the art. Nucleic acids may be naturally occurring, e.g. DNA or RNA, or may be synthetic analogs, as known in the art. Such analogs may be preferred for use as probes because of superior stability under assay conditions. Modifications in the native structure, including alterations in the backbone, sugars or heterocyclic bases, have been shown to increase intracellular stability and binding affinity. Among useful changes in the backbone chemistry are phosphorothioates; phosphorodithioates, where both of the non-bridging oxygens are substituted with sulfur; phosphoroamidites; alkyl phosphotriesters and boranophosphates. Achiral phosphate derivatives include 3'-O'-5'-S-phosphorothioate, 3'-S-5'-O-phosphorothioate, 3'-CH2-5'-O-phosphonate and 3'-NH-5'-O-phosphoroamidate. Peptide nucleic acids replace the entire ribose phosphodiester backbone with a peptide linkage.

Sugar modifications are also used to enhance stability and affinity. The α-anomer of deoxyribose may be used, where the base is inverted with respect to the natural β-anomer. The 2'-OH of the ribose sugar may be altered to form 2'-O-methyl or 2'-O-allyl sugars, which provides resistance to degradation without comprising affinity.

Modification of the heterocyclic bases must maintain proper base pairing. Some useful substitutions include deoxyuridine for deoxythymidine; 5-methyl-2'-deoxycytidine and 5-bromo-2'-deoxycytidine for deoxycytidine. 5-propynyl-2'-deoxyuridine and 5-propynyl-2'-deoxycytidine have been shown to increase affinity and biological activity when substituted for deoxythymidine and deoxycytidine, respectively.

A "small interfering" or "short interfering RNA" or siRNA is a RNA duplex of nucleotides that is targeted to a gene interest (a "target gene"). An "RNA duplex" refers to the structure formed by the complementary pairing between two regions of a RNA molecule. siRNA is "targeted" to a gene in that the nucleotide sequence of the duplex portion of the siRNA is complementary to a nucleotide sequence of the targeted gene. In some embodiments, the length of the duplex of siRNAs is less than 30 nucleotides. In some embodiments, the duplex can be 29, 28, 27, 26, 25, 24, 23, 22, 21, 20, 19, 18, 17, 16, 15, 14, 13, 12, 11 or 10 nucleotides in length. In some embodiments, the length of the duplex is 19-25 nucleotides in length. The RNA duplex portion of the siRNA can be part of a hairpin structure. In addition to the duplex portion, the hairpin structure may contain a loop portion positioned between the two sequences that form the duplex. The loop can vary in length. In some embodiments the loop is 5, 6, 7, 8, 9, 10, 11, 12 or 13 nucleotides in length. The hairpin structure can also contain 3' or 5' overhang portions. In some embodiments, the overhang is a 3' or a 5' overhang 0, 1, 2, 3, 4 or 5 nucleotides in length.

The terms "polypeptide" and "protein", used interchangeably herein, refer to a polymeric form of amino acids of any length, which can include coded and non-coded amino acids, chemically or biochemically modified or derivatized amino acids, and polypeptides having modified peptide backbones. The term includes fusion proteins, including, but not limited to, fusion proteins with a heterologous amino acid sequence, fusions with heterologous and homologous leader sequences, with or without N-terminal methionine residues; immunologically tagged proteins; and the like.

A "substantially isolated" or "isolated" polynucleotide is one that is substantially free of the sequences with which it is associated in nature. By substantially free is meant at least 50%, preferably at least 70%, more preferably at least 80%, and even more preferably at least 90% free of the materials with which it is associated in nature. As used herein, an "isolated" polynucleotide also refers to recombinant polynucleotides, which, by virtue of origin or manipulation: (1) are not associated with all or a portion of a polynucleotide with which it is associated in nature, (2) are linked to a polynucleotide other than that to which it is linked in nature, or (3) does not occur in nature.

Hybridization reactions can be performed under conditions of different "stringency". Conditions that increase stringency of a hybridization reaction of widely known and published in the art. See, for example, Sambrook et al. (1989). Examples of relevant conditions include (in order of increasing stringency): incubation temperatures of 25° C., 37° C., 50° C. and 68° C.; buffer concentrations of 10×SSC, 6×SSC, 1×SSC, 0.1×SSC (where 1×SSC is 0.15 M NaCl and 15 mM citrate buffer) and their equivalents using other buffer systems; formamide concentrations of 0%, 25%, 50%, and 75%; incubation times from 5 minutes to 24 hours; 1, 2, or more washing steps; wash incubation times of 1, 2, or 15 minutes; and wash solutions of 6×SSC, 1×SSC, 0.1×SSC, or deionized water. An example of stringent hybridization conditions is hybridization at 50° C. or higher and 0.1×SSC (15 mM sodium chloride/1.5 mM sodium citrate). Another example of stringent hybridization conditions is overnight incubation at 42° C. in a solution: 50% formamide, 1×SSC (150 mM NaCl, 15 mM sodium citrate), 50 mM sodium phosphate (pH 7.6), 5×Denhardt's solution, 10% dextran sulfate, and 20 µg/ml denatured, sheared salmon sperm DNA, followed by washing the filters in 0.1×SSC at about 65° C. Stringent hybridization conditions are hybridization conditions that are at least as stringent as the above representative conditions. Other stringent hybridization conditions are known in the art and may also be employed to identify nucleic acids of this particular embodiment of the invention.

"$T_m$" is the temperature in degrees Celsius at which 50% of a polynucleotide duplex made of complementary strands hydrogen bonded in anti-parallel direction by Watson-Crick base pairing dissociates into single strands under conditions of the experiment. $T_m$ may be predicted according to a standard formula, such as:

$$T_m = 81.5 + 16.6 \log [X^+] + 0.41 (\% \ G/C) - 0.61 (\% \ F) - 600/L$$

where [$X^+$] is the cation concentration (usually sodium ion, $Na^+$) in mol/L; (% G/C) is the number of G and C residues as a percentage of total residues in the duplex; (% F) is the percent formamide in solution (wt/vol); and L is the number of nucleotides in each strand of the duplex.

A polynucleotide or polypeptide has a certain percent "sequence identity" to another polynucleotide or polypeptide, meaning that, when aligned, that percentage of bases or amino acids are the same when comparing the two sequences. Sequence similarity can be determined in a number of different manners. To determine sequence identity, sequences can be aligned using the methods and computer programs, including BLAST, available over the world wide web at http://www.ncbi.nlm.nih.gov/BLAST/. Another alignment algorithm is FASTA, available in the Genetics Computing Group (GCG) package, from Madison, Wis., USA, a wholly owned subsidiary of Oxford Molecular Group, Inc. Other techniques for alignment are described in Methods in Enzymology, vol. 266: Computer Methods for Macromolecular Sequence Analysis (1996), ed. Doolittle, Academic Press, Inc., a division of Harcourt Brace & Co., San Diego, Calif., USA. Of particular interest are alignment programs that permit gaps in the sequence. The Smith-Waterman is one type of algorithm that permits gaps in sequence alignments. See *Meth. Mol. Biol.* 70: 173-187 (1997). Also, the GAP program using the Needleman and Wunsch alignment method can be utilized to align sequences. See *Mol. Biol.* 48: 443-453 (1970)

Of interest is the BestFit program using the local homology algorithm of Smith Waterman (Advances in Applied Mathematics 2: 482-489 (1981) to determine sequence identity. The gap generation penalty will generally range from 1 to 5, usually 2 to 4 and in many embodiments will be 3. The gap extension penalty will generally range from about 0.01 to 0.20 and in many instances will be 0.10. The program has default parameters determined by the sequences inputted to be compared. Preferably, the sequence identity is determined using the default parameters determined by the program. This program is available also from Genetics Computing Group (GCG) package, from Madison, Wis., USA.

Another program of interest is the FastDB algorithm. FastDB is described in Current Methods in Sequence Comparison and Analysis, Macromolecule Sequencing and Synthesis, Selected Methods and Applications, pp. 127-149, 1988, Alan R. Liss, Inc, Percent sequence identity is calculated by FastDB based upon the following parameters:

| | |
|---|---|
| Mismatch Penalty: | 1.00; |
| Gap Penalty: | 1.00; |
| Gap Size Penalty: | 0.33; and |
| Joining Penalty: | 30.0. |

One parameter for determining percent sequence identity is the "percentage of the alignment region length" where the strongest alignment is found.

The percentage of the alignment region length is calculated by counting the number of residues of the individual sequence found in the region of strongest alignment. This number is divided by the total residue length of the target or query polynucleotide sequence to find a percentage. An example is shown below:

```
Target sequence:  ababadddcdbcbdbcbadaa
                  |   ||| |||| |||
Query sequence :  cdcdabbbcdb.bdbcdadacbb
                  1   5   10    15
``` where
a = guanine;
b = cytosine;
c = thymine;
and
d = adenine.

The region of alignment begins at residue 9 and ends at residue 19. The total length of the target sequence is 20 residues. The percent of the alignment region length is 11 divided by 20 or 55%, for example.

Percent sequence identity is calculated by counting the number of residue matches between the target and query polynucleotide sequence and dividing total number of matches by the number of residues of the target or query sequence found in the region of strongest alignment. For the example above, the percent identity would be 10 matches divided by 11 residues, or approximately, 90.9%.

The percent of the alignment region length is typically at least about 55% of total length of the sequence, more typically at least about 58%, and even more typically at least about 60% of the total residue length of the sequence. Usually, percent length of the alignment region can be as great as about 62%, more usually as great as about 64% and even more usually as great as about 66%.

Stringent conditions for both DNA/DNA and DNA/RNA hybridization are as described by Sambrook et al. *Molecular Cloning, A Laboratory Manual*, 2nd Ed., Cold Spring Harbor Laboratory Press, Cold Spring Harbor, N.Y., 1989, herein incorporated by reference. For example, see page 7.52 of Sambrook et al.

The term "host cell" includes an individual cell or cell culture which can be or has been a recipient of any recombinant vector(s) or isolated polynucleotide of the invention. Host cells include progeny of a single host cell, and the progeny may not necessarily be completely identical (in morphology or in total DNA complement) to the original parent cell due to natural, accidental, or deliberate mutation and/or change. A host cell includes cells transfected or infected in vivo or in vitro with a recombinant vector or a polynucleotide of the invention. A host cell which comprises a recombinant vector of the invention is a "recombinant host cell."

The term "binds specifically," in the context of antibody binding, refers to high avidity and/or high affinity binding of an antibody to a specific polypeptide i.e., epitope of a sulfatase polypeptide. Antibody binding to an epitope on a specific sulfatase polypeptide (also referred to herein as "a sulfatase epitope") is preferably stronger than binding of the same antibody to any other epitope, particularly those which may be present in molecules in association with, or in the same sample, as the specific polypeptide of interest e.g., binds more strongly to a specific sulfatase epitope than to a different sulfatase epitope so that by adjusting binding conditions the antibody binds almost exclusively to the specific sulfatase epitope and not to any other sulfatase epitope, and not to any other sulfatase polypeptide which does not comprise the epitope. Antibodies which bind specifically to a subject polypeptide may be capable of binding other polypeptides at a weak, yet detectable, level (e.g., 10% or less of the binding shown to the polypeptide of interest). Such weak binding, or background binding, is readily discernible from the specific antibody binding to a subject polypeptide, e.g. by use of appropriate controls. In general, antibodies of the invention which bind to a specific sulfatase polypeptide with a binding affinity of $10^{-7}$ M or more, preferably $10^{-8}$ M or more (e.g., $10^{-9}$ M, $10^{-10}$, $10^{-11}$, etc.). In general, an antibody with a binding affinity of $10^{-6}$ M or less is not useful in that it will not bind an antigen at a detectable level using conventional methodology currently used.

A "biological sample" encompasses a variety of sample types obtained from an individual and can be used in a diagnostic or monitoring assay. The definition encompasses blood and other liquid samples of biological origin, solid tissue samples such as a biopsy specimen or tissue cultures or cells derived therefrom and the progeny thereof. The definition also includes samples that have been manipulated in any way after their procurement, such as by treatment with reagents, solubilization, or enrichment for certain components, such as polynucleotides or polypeptides. The term "biological sample" encompasses a clinical sample, and also includes cells in culture, cell supernatants, cell lysates, serum, plasma, biological fluid, and tissue samples.

The term "angiogenesis" refers to a process of tissue vascularization that involves the development of new vessels. Angiogenesis occurs via one of three mechanisms: (1) neovascularization, where endothelial cells migrate out of pre-existing vessels beginning the formation of the new vessels; (2) vasculogenesis, where the vessels arise from precursor cells de novo; or (3) vascular expansion, where existing small vessels enlarge in diameter to form larger vessels (Blood, et al. (1990) *Biochem. Biophys. Acta.* 1032:89-118).

The terms "cancer," "neoplasm," and "tumor" are used interchangeably herein to refer to cells which exhibit relatively autonomous growth, so that they exhibit an aberrant growth phenotype characterized by a significant loss of control of cell proliferation. Cancerous cells can be benign or malignant.

As used herein, the terms "treatment," "treating," and the like, refer to obtaining a desired pharmacologic and/or physiologic effect. The effect may be prophylactic in terms of completely or partially preventing a disease or symptom thereof and/or may be therapeutic in terms of a partial or complete cure for a disease and/or adverse affect attributable to the disease. "Treatment", as used herein, covers any treatment of a disease in a mammal, particularly in a human, and includes: (a) preventing the disease from occurring in a subject which may be predisposed to the disease but has not yet been diagnosed as having it; (b) inhibiting the disease, i.e., arresting its development; and (c) relieving the disease, i.e., causing regression of the disease.

The terms "individual," "subject," "host," and "patient," used interchangeably herein, refer to a mammal, including, but not limited to, murines, simians, humans, felines, canines, equines, bovines, mammalian farm animals, mammalian sport animals, and mammalian pets.

Before the present invention is further described, it is to be understood that this invention is not limited to particular embodiments described, as such may, of course, vary. It is also to be understood that the terminology used herein is for the purpose of describing particular embodiments only, and is not intended to be limiting, since the scope of the present invention will be limited only by the appended claims.

Where a range of values is provided, it is understood that each intervening value, to the tenth of the unit of the lower limit unless the context clearly dictates otherwise, between the upper and lower limit of that range and any other stated or intervening value in that stated range, is encompassed within the invention. The upper and lower limits of these smaller ranges may independently be included in the smaller ranges, and are also encompassed within the invention, subject to any specifically excluded limit in the stated range. Where the stated range includes one or both of the limits, ranges excluding either or both of those included limits are also included in the invention.

Unless defined otherwise, all technical and scientific terms used herein have the same meaning as commonly understood by one of ordinary skill in the art to which this invention belongs. Although any methods and materials similar or equivalent to those described herein can also be used in the practice or testing of the present invention, the preferred methods and materials are now described. All publications mentioned herein are incorporated herein by reference to disclose and describe the methods and/or materials in connection with which the publications are cited.

It must be noted that as used herein and in the appended claims, the singular forms "a," "and," and "the" include plural referents unless the context clearly dictates otherwise. Thus, for example, reference to "a sulfatase" includes a plurality of such sulfatases and reference to "the agent" includes reference to one or more agents and equivalents thereof known to those skilled in the art, and so forth. It is further noted that the claims may be drafted to exclude any optional element. As such, this statement is intended to serve as antecedent basis for use of such exclusive terminology as "solely," "only" and the like in connection with the recitation of claim elements, or use of a "negative" limitation.

The publications discussed herein are provided solely for their disclosure prior to the filing date of the present application. Nothing herein is to be construed as an admission that the present invention is not entitled to antedate such publication by virtue of prior invention. Further, the dates of publication provided may be different from the actual publication dates which may need to be independently confirmed.

DETAILED DESCRIPTION OF THE INVENTION

Overview

Sulfatases are a family of enzymes that release sulfate from glycoproteins, sulfolipids, and proteoglycans. The present invention provides novel sulfatases and polypeptides related thereto, as well as nucleic acid compositions encoding the same. The subject polypeptide and/or nucleic acid compositions find use in a variety of different applications, including various diagnostic and therapeutic agent screening/discovery/preparation applications.

In many embodiments, a novel sulfatase of the invention exhibits one or more of the following properties: (1) exhibits glucosamine-6-sulfatase activity; (2) is an endosulfatase, removing sulfate from the C-6 position of internal glucosamines as well as from glucosamines at the non-reducing termini of polysaccharides (3) removes a sulfate group from glycoproteins and/or proteoglycans; (4) is secreted from a eukaryotic cell; (5) acts on extracellular matrix (ECM) components to remove a sulfate group, resulting in release from the ECM of extracellular differentiation factors and/or growth factors; (6) mRNA encoding the sulfatase shows elevated expression in tumors; (7) is secreted in greater abundance from a cancerous cell as compared to a non-cancerous cell of the same cell and/or tissue type; (8) exhibits endoglucosamine-6-sulfatase activity on heparin, e.g., removes 6-sulfate groups from heparin and from heparan sulfate chains within heparan sulfate proteoglycans; and (9) is pro-angiogenic.

The subject sulfatases are expressed at elevated levels in tumors, compared with normal tissue. Without wishing to be bound by any particular theory, it is believed that a subject sulfatase can be secreted from a tumor cell, and acts on component(s) of the ECM or from the cell surface to release or potentiate the function of one or more differentiation factors or growth factors, including angiogenic factor(s). In one scenario, Angiogenic factors then act on local endothelial cells and promote angiogenesis, resulting in access of the tumor to the vasculature, and therefore to the blood supply. By reducing access of a tumor to the vasculature, one can reduce tumor growth.

Polypeptide Compositions

Novel sulfatases, as well as polypeptide compositions related thereto, are provided. The invention provides a sulfatase present in other than its natural environment. Novel sulfatases of the invention encompass SULF1 and SULF2. In some embodiments, a subject sulfatase is a human sulfatase. In other embodiments, a subject sulfatase is a mouse sulfatase.

In particular embodiments, a subject sulfatase has an amino acid sequence substantially identical to the sequence of any one of SEQ ID NOS:03, 06, 09, 12, 15, and 18. In other particular embodiments, a subject sulfatase has an amino acid sequence substantially identical to any one of the sequences depicted in FIG. 1C, FIG. 2C, FIG. 3C, FIG. 4C, FIG. 10C, and FIG. 11C.

In many embodiments, a novel sulfatase of the invention exhibits one or more of the following properties: (1) exhibits glucosamine-6-sulfatase activity; (2) is an endosulfatase, removing sulfate from the C-6 position of internal glucosamines as well as from glucosamines at the non-reducing termini of polysaccharides (3) removes a sulfate group from glycoproteins and/or proteoglycans; (4) is secreted from a eukaryotic cell; (5) acts on extracellular matrix (ECM) components to remove a sulfate group, resulting in release from the ECM of extracellular differentiation factors and/or growth factors; 6) is retained on the surface of the tumor cells and modifies the interaction of differentiation/factors with HSPGs on the cell surface in such a way as to potentiate the function of the factor; (7) mRNA encoding the sulfatase shows elevated expression in tumors; (8) is produced in greater abundance from a cancerous cell as compared to a non-cancerous cell of the same cell and/or tissue type; (9) exhibits endoglucosamine-6-sulfatase activity on heparin, e.g., removes 6-sulfate groups from heparan sulfate chains; (10) is pro-angiogenic; 11) induces cell proliferation of the tumor cells.

The invention also provides fragments of the subject sulfatases. In some embodiments, fragments exhibit sulfatase activity. Fragments find utility in generating antibodies to the full-length sulfatases; and in methods of screening for candidate agents that bind to and/or modulate sulfatase enzymatic activity. The term "sulfatase polypeptide composition" as used herein refers to both the full-length human protein as well as portions or fragments thereof. Also included in this term are variations of the naturally occurring human protein, where such variations are homologous or substantially similar to the naturally occurring protein, as described in greater detail below, as well as corresponding homologs from non-human species, such as other mammalian species. In the following description of the subject invention, the terms "SULF1" and "SULF2" are used to refer not only to the human form of these novel sulfatases, but also to homologs thereof expressed in non-human species.

Human SULF1 huSULF1; HSulf-1) is an 871 amino acid protein having an amino acid sequence as shown in FIG. 1C and identified as SEQ ID NO:03. HuSULF1 has a molecular weight based on its amino acid of about 80 to about 100 kDa.

Human SULF2 huSULF2; HSulf-2) is an 870 amino acid protein having an amino acid sequence as shown in FIG. 2C and identified as SEQ ID NO:06. HuSULF2 has a molecular weight based on its amino acid of about 80 to about 100 kDa.

In some embodiments, a subject sulfatase has an amino acid sequence as shown in FIG. 10C and as set forth in SEQ ID NO: 15.

Mouse SULF1 (mSULF1) is an 870 amino acid protein having an amino acid sequence as shown in FIG. 3C and as set forth in SEQ ID NO:09.

Mouse SULF2 (mSULF2) is an 875 amino acid protein having an amino acid sequence as shown in FIG. 4C and as set forth in SEQ ID NO:12. In some embodiments, a subject sulfatase has an amino acid sequence as shown in FIG. 11C and as set forth in SEQ ID NO:18.

The subject sulfatases have a molecular weight of between 80 and 100 kDa based on their amino acid sequences. Subject sulfatases produced by a eukaryotic cell are glycosylated, and in some embodiments have a molecular weight of about 126 kDa. In addition, in some embodiments, a subject sulfatase is proteolytically cleaved to produce fragments of from about 60 kDa to about 70 kDa (e.g., 61 kDa, 66 kDa, 71 kDa); from about 48 kDa to about 55 kDa (e.g., 49 kDa, 53 kDa); or from about 40 to about 55 kDa (e.g., 40 kDa, 49 kDa, 53 kDa). Many of these fragments or associations of these fragments have sulfatase activity.

In addition to the above specifically listed proteins, sulfatases from other species are also provided, including mammals, such as: rodents, e.g. mice, rats; domestic animals, e.g. horse, cow, dog, cat; and humans, as well as non-mammalian species, e.g. avian, and the like. By homolog is meant a protein having at least about 35%, at least about 40%, at least about 60%, at least about 70%, at least about 75%, at least about 80%, at least about 90%, or at least about 95%, or higher, amino acid sequence identity to the one of the above specifically listed sulfatases, as measured by using the "GAP" program (part of the Wisconsin Sequence Analysis Package available through the Genetics Computer Group, Inc. (Madison Wis.)), where the parameters are: Gap weight:12; length weight:4. In many embodiments of interest, homology will be at least 75, usually at least 80 and more usually at least 85%, where in certain embodiments of interest homology will be as high as 90%.

Also provided are sulfatase proteins that are substantially identical to the above listed proteins, where by substantially identical is meant that the protein has an amino acid sequence identity to the sequence one of the above listed proteins of at least about 75%, at least about 80% at least about 85%, at least about 90%, at least about 95%, or at least about 98%.

The proteins of the subject invention (e.g. SULF1, SULF2, huSULF1, huSULF2, mSULF1, mSULF2, and the like) are present in a non-naturally occurring environment, e.g. are separated from their naturally occurring environment. In certain embodiments, the subject proteins are present in a composition that is enriched for subject protein as compared to its naturally occurring environment. For example, purified sulfatases are provided, where by purified is meant that the sulfatase is present in a composition that is substantially free of non-sulfatase proteins, where by substantially free is meant that less than 90%, usually less than 60% and more usually less than 50% of the composition is made up of non-sulfatase proteins.

The proteins of the subject invention may also be present as an isolate, by which is meant that the protein is substantially free of other proteins and other naturally occurring biologic molecules, such as oligosaccharides, polynucleotides and fragments thereof, and the like, where substantially free in this instance means that less than 70%, usually less than 60% and more usually less than 50% of the composition containing the isolated protein is some other naturally occurring biological molecule. In certain embodiments, the proteins are present in substantially pure form, where by substantially pure form is meant at least 95%, usually at least 97% and more usually at least 99% pure.

In addition to the naturally occurring proteins, polypeptides which vary from the naturally occurring proteins (e.g., huSULF1, huSULF2, mSULF1, mSULF2, etc.) are also provided. By SULF1 and SULF2 polypeptide is meant an amino acid sequence encoded by an open reading frame (ORF) of the SULF1 and SULF2 gene, described in greater detail below, including the full length SULF1 and SULF2 protein and fragments thereof, particularly biologically active fragments and/or fragments corresponding to functional domains, e.g., sulfatase active site; and including fusions of the subject polypeptides to other proteins or parts thereof. Fusion proteins may comprise a subject polypeptide, or fragment thereof, and a non-SULF polypeptide ("the fusion partner") fused in-frame at the N-terminus and/or C-terminus of the subject SELF polypeptide.

Fusion partners include, but are not limited to, polypeptides that can bind antibody specific to the fusion partner (e.g., epitope tags, e.g., hemagglutinin (HA; e.g., CYPYDVPDYA; SEQ ID NO:19), FLAG (e.g., DYKDDDDK; SEQ ID NO:20), c-myc (e.g., CEQKLISEEDL; SEQ ID NO:21), and the like); polypeptides that provide a detectable signal (e.g., a fluorescent protein, e.g., a green fluorescent protein, a fluorescent protein from an Anthozoan species; β-galactosidase; luciferase; and the like); polypeptides that provide a catalytic function or induce a cellular response; polypeptides that provide for secretion of the fusion protein from a eukaryotic cell; polypeptides that provide for secretion of the fusion protein from a prokaryotic cell; polypeptides that provide for binding to metal ions (e.g., histidine polymers, e.g., $His_n$, where n=3-10, e.g., 6His); and the like.

In some embodiments, a SULF polypeptide of the invention comprises at least about 10, at least about 20, at least about 25, at least about 50, at least about 75, at least about 100, at least about 150, at least about 200, at least about 250, at least about 300, at least about 350, at least about 400, at least about 450, at least about 500, at least about 550, at least about 600, at least about 650, at least about 700, at least about 750, at least about 800, or at least about 850 contiguous amino acids of one of the sequences as set forth in any one of SEQ ID NOS:3, 6, 9, 12, 15, and 18, and in FIGS. 1C, 2C, 3C, 4C, 10C, and 11C, up to the entire amino acid sequence as set forth in any one of SEQ ID NOS:3, 6, 9, 12, 15, and 18, and in FIGS. 1C, 2C, 3C, 4C, 10C, and 11C.

Fragments of the subject polypeptides, as well as polypeptides comprising such fragments, are also provided. Fragments of SULF1 and SULF2 of interest will typically be at least about 10 amino acids (aa) in length, usually at least about 50 aa in length, and may be as long as 300 aa in length or longer, where the fragment will have a stretch of amino acids that is identical to the subject protein of at least about 10 aa, and usually at least about 15 aa, and in many embodiments at least about 50 aa in length.

Specific fragments of interest include a sulfatase domain. The first sulfatase domain encompasses from about amino acid 42 to about amino acid 389 or from about amino acid 42 to about amino acid 415 of a subject sulfatase. The sulfatase domain cleaves the sulfate moiety from N-acetylglucosamine-6-sulfate or glucosamine-6-sulfate structures within heparan sulfate glycosamino glycans and related glycoconjugates.

Accordingly, in some embodiments, a subject sulfatase fragment is from about amino acid 40 to about amino acid 390, or from about amino acid 40 to about amino acid 415, of any one of SEQ ID NOs:03, 06, 09, 12, 15, or 18, or variants thereof, especially variants containing conserved amino acid substitutions. The invention provides polypeptides comprising such fragments, including, e.g., fusion polypeptides comprising a subject sulfatase fragment fused in frame (directly or indirectly) to a heterologous protein. Suitable heterologous proteins include, but are not limited to, a protein that serves as a detectable marker (e.g., a fluorescent protein, β-galactosidase, luciferase); an immunologically detectable protein (e.g., an epitope tag); and a structural protein.

Within the first sulfatase domains are cleavage sites for the furin/PACE protease processing enzymes. This cleavage occurs between residues 408 (arginine) and 409 (aspartic acid) and/or between 576 (arginine) and 577 (histidine), and/or between 661 (arginine) and 662 (glutamic acid), and/or between 669 (arginine) and 670 (arginine), and/or between 732 (arginine) and 733 (glutamine) of hsulf-1. The cleavage occurs between 409 (arginine) and 410 (aspartic acid) and/or between 423 (arginine) and 424 (aspartic acid) and/or between 538 (arginine) and 539 (serine) and/or between 565 (arginine) and 566 (histidine), and/or between 646 (arginine) and 647 (glutamic), and/or between 656 (arginine) and 657 (proline) and/or between 848 (arginine) and 849 (lysine) of hsulf-2. Cleavage is necessary for activity of the enzyme. Accordingly, in many embodiments, a subject sulfatase is cleaved at one or more furin/PACE cleavage sites. Thus, in many embodiments, a subject sulfatase includes amino acids from about 1 to about amino acid 408 or 409 (e.g., up to the first furin/PACE cleavage site).

Sulfatase fragments, and polypeptides comprising sulfatase fragments, such as the sulfatase fragments described above, are useful in screening assays, to identify agents that modulate an activity, e.g., an enzymatic activity, of a subject sulfatase. Screening assays are described in more detail below. For example, a polypeptide comprising a first sulfatase domain is used in a screening assay to identify agents that modulate cleavage of the sulfate moiety from the N-acetylglusamine-6-sulfate or glucosamine-6-sulfate structures within heparan sulfate glycosamino glycans and related glycoconjugates.

A subject polypeptide may further include a glucosamine-6-sulfate (G6S-related) domain of a subject sulfatase. A G6S-related domain is involved in substrate recognition. Thus, a G6S-related domain binds to a glucosamine/GlcNAc component of a substrate of a subject sulfatase. The G6S-related domain is a region of approximately 108 amino acids near the carboxyl terminus of the sulfatase. A G6S-related domain is from about 90 to about 120, from about 95 to about 115, or from about 100 to about 110 amino acids in length. For example, the G6S-related domain is from about amino acid 700 to about amino acid 870, from about 710 to about amino acid 850 of a subject sulfatase. Exemplary 068-related domains are amino acids 736-843 of human sulfatase-1; amino acids 735 to 842 of mouse sulfatase-1, amino acids 717 to 824 of human sulfatase-2; and amino acids 722 to 829 of mouse sulfatase-2. The invention provides polypeptides comprising such G6S-related fragments, including, e.g., fusion polypeptides comprising a subject sulfatase fragment fused in frame (directly or indirectly) to a heterologous protein. Suitable heterologous proteins include, but are not limited to, a protein that serves as a detectable marker (e.g., a fluorescent protein, 1-galactosidase, luciferase); an immunologically detectable protein (e.g., an epitope tag); and a structural protein.

A G6S-related fragment of a subject sulfatase, or a polypeptide comprising a G6S-related domain of a subject sulfatase, is useful for identifying agents that target the G6S-related domain. Agents thus identified are useful in reducing the activity of a subject sulfatase, because a reduction in substrate recognition results in reduction in the rate and/or degree of sulfate moiety removal from the substrate by the catalytic (sulfatase) domain of a subject sulfatase.

The invention further provides a coiled-coil domain fragment of a subject sulfatase, and polypeptides comprising such fragments. A coiled-coil domain serves as a multimerization element. A coiled-coil domain of a subject sulfatase is from about 30 to about 40 amino acids in length, e.g., about 34-35 amino acids in length. A coiled-coil domain is found in a region of from about amino acid 600 to about amino acid 700, from about amino acid 620 to about amino acid 680, from about amino acid 630 to about amino acid 670, or from about amino acid 640 to about amino acid 660 of a subject sulfatase. The invention provides polypeptides comprising such coiled-coil fragments, including, e.g., fusion polypeptides comprising a subject sulfatase fragment fused in frame (directly or indirectly) to a heterologous protein. Suitable heterologous proteins include, but are not limited to, a protein that serves as a detectable marker (e.g., a fluorescent protein, β-galactosidase, luciferase); an immunologically detectable protein (e.g., an epitope tag); and a structural protein.

A coiled-coil fragment, or a polypeptide comprising a coiled-coil domain of a subject sulfatase is useful in screening assays to identify compounds that disrupt or reduce a biological activity of a subject sulfatase. A compound thus identified is useful for reducing a biological activity of a subject sulfatase.

The subject proteins and polypeptides may be obtained from naturally occurring sources or synthetically produced. Where obtained from naturally occurring sources, the source chosen will generally depend on the species from which the protein is to be derived. The subject proteins may also be derived from synthetic means, e.g. by expressing a recombinant gene encoding protein of interest in a suitable host, as described in greater detail below. Any convenient protein purification procedures may be employed, where suitable protein purification methodologies are described in Guide to Protein Purification, (Deuthser ed.) (Academic Press, 1990). For example, a lysate may be prepared from the original source and purified using HPLC, exclusion chromatography, gel electrophoresis, affinity chromatography, and the like.

Nucleic Acid Compostions

Also provided are nucleic acid compositions encoding the subject novel sulfatases or fragments thereof. By nucleic acid composition is meant a composition comprising a sequence of DNA having an open reading frame that encodes one the subject sulfatases and is capable, under appropriate conditions, of being expressed as one of the subject sulfatases described above. Thus, the term encompasses genomic DNA, cDNA, mRNA, and vectors comprising the subject nucleic acid sequences. Also encompassed in this term are nucleic acids that are homologous or substantially similar or identical to the nucleic acids encoding the subject sulfatase proteins. Thus, the subject invention provides genes encoding huSULF1, huSULF2, mSULF1, mSULF2, and homologs thereof.

The human SULF1cDNA has the nucleic acid sequence shown in FIGS. 1A and 1B, and identified as SEQ ID NO:01. The coding region is depicted by nucleotides shown in upper case letters in FIGS. 1A and 1B. The coding region is set forth in SEQ ID NO:02.

The human SULF2 cDNA has the nucleic acid sequence shown in FIGS. 2A and 2B, and identified as SEQ ID NO:04.

The coding region is depicted by nucleotides shown in upper case letters in FIGS. 2A and 2B. The coding region is set forth in SEQ ID NO:05.

In some embodiments, a human SULF2 cDNA has the nucleic acid sequence shown in FIGS. 10A and 10B and set forth in SEQ ID NO:13, with the open reading frame (coding region) set forth in SEQ ID NO:14.

The mouse SULF1 cDNA has the nucleic acid sequence shown in FIGS. 3A and 3B, and identified as SEQ ID NO:07. The coding region is depicted by nucleotides shown in upper case letters in FIGS. 3A and 3B. The coding region is set forth in SEQ ID NO:08.

The mouse SULF2 cDNA has the nucleic acid sequence shown in FIGS. 4A and 4B, and identified as SEQ ID NO: 10. The coding region is depicted by nucleotides shown in upper case letters in FIGS. 4A and 4B. The coding region is set forth in SEQ ID NO:11. In some embodiments, a mouse SULF2 cDNA has the nucleic acid sequence shown in FIGS. 11A-11B, and set forth in SEQ ID NO:16, with the open reading frame set forth in SEQ ID NO:17.

In some embodiments, a SULF polynucleotide of the invention comprises a nucleotide sequence of at least about 30, at least about 50, at least about 75, at least about 100, at least about 150, at least about 200, at least about 300, at least about 400, at least about 500, at least about 600, at least about 700, at least about 800, at least about 900, at least about 1000, at least about 1100, at least about 1200, at least about 1300, at least about 1400, at least about 1500, at least about 1600, at least about 1700, at least about 1800, at least about 1900, at least about 2000, at least about 2100, at least about 2200, at least about 2300, at least about 2400, at least about 2500, or at least about 2600 contiguous nucleotides of the sequence set forth in one of SEQ ID NOS:1, 4, 7, 10, 13, or 16; or as set forth in any one of SEQ ID NOS:2, 5, 8, 11, 14, or 17; or in one of FIGS. 1A-1B, 2A-2B, 3A-3B, 4A-4B, 10A-10B, or 11A-11B.

In some embodiments, a SULF polynucleotide of the invention specifically excludes the sequences set forth in one or more of SEQ ID NO:01, 02, 04, 05, 13, and 14.

In other embodiments, a SULF polynucleotide of the invention comprises a nucleotide sequence that encodes a polypeptide comprising an amino acid sequence of at least about 10, at least about 20, at least about 25, at least about 50, at least about 75, at least about 100, at least about 150, at least about 200, at least about 250, at least about 300, at least about 350, at least about 400, at least about 450, at least about 500, at least about 550, at least about 600, at least about 650, at least about 700, at least about 750, at least about 800, or at least about 850 contiguous amino acids of one of the sequences as set forth in any one of SEQ ID NOS:3, 6, 9, 12, 15, or 18, or as depicted in one or FIGS. 1C, 2C, 3C, 4C, 10C, and 11C, up to the entire amino acid sequence as set forth in one of SEQ ID NOS:3, 6, 9, 12, 15, or 18, or as depicted in one or FIGS. 1C, 2C, 3C, 4C, 10C, and 11C.

The source of homologous genes may be any species, e.g., primate species, particularly human; rodents, such as rats and mice, canines, felines, bovines, ovines, equines, yeast, nematodes, etc. Between mammalian species, e.g., human and mouse, homologs have substantial sequence similarity, e.g. at least 60% sequence identity, usually at least 75%, more usually at least 80% between nucleotide sequences. In many embodiments of interest, homology will be at least 75, usually at least 80 and more usually at least 85%, where in certain embodiments of interest homology will be as high as 90%. Sequence similarity is calculated based on a reference sequence, which may be a subset of a larger sequence, such as a conserved motif, coding region, flanking region, etc. A reference sequence will usually be at least about 18 nt long, more usually at least about 30 nt long, and may extend to the complete sequence that is being compared. Algorithms for sequence analysis are known in the art, such as BLAST, described in Altschul et al. (1990), *J Mol. Biol.* 215:403-10 (using default settings). The sequences provided herein are essential for recognizing related and homologous proteins in database searches.

Nucleic acids encoding the proteins and polypeptides of the subject invention may be cDNA or genomic DNA or a fragment thereof. The term gene shall be intended to mean the open reading frame encoding specific proteins and polypeptides of the subject invention, and introns, as well as adjacent 5' and 31 non-coding nucleotide sequences involved in the regulation of expression, up to about 20 kb beyond the coding region, but possibly further in either direction. The gene may be introduced into an appropriate vector for extrachromosomal maintenance or for integration into a host genome.

The term "cDNA" as used herein is intended to include all nucleic acids that share the arrangement of sequence elements found in native mature mRNA species, where sequence elements are exons and 3' and 5' non-coding regions. Normally mRNA species have contiguous exons, with the intervening introns, when present, being removed by nuclear RNA splicing, to create a continuous open reading frame encoding a protein according to the subject invention.

A genomic sequence of interest comprises the nucleic acid present between the initiation codon and the stop codon, as defined in the listed sequences, including all of the introns that are normally present in a native chromosome. It may further include the 3' and 5' untranslated regions found in the mature mRNA. It may further include specific transcriptional and translational regulatory sequences, such as promoters, enhancers, etc., including about 1 kb, but possibly more, of flanking genomic DNA at either the 5' or 3' end of the transcribed region. The genomic DNA may be isolated as a fragment of 100 kbp or smaller; and substantially free of flanking chromosomal sequence. The genomic DNA flanking the coding region, either 3' or 5', or internal regulatory sequences as sometimes found in introns, contains sequences required for proper tissue and stage specific expression.

The genomic sequence of human SULF2 is set forth in SEQ ID NO:22. The genomic sequence of human SULF1 is set forth in SEQ ID NO:23. The genomic sequence of mouse SULF2 is set forth in SEQ ID NO:24. In particular embodiments, a subject genomic sequence has the sequence as set forth in any one of SEQ ID NO:22, 23, or 24.

The nucleic acid compositions of the subject invention may encode all or a part of the subject proteins. Double or single stranded fragments may be obtained from the DNA sequence by chemically synthesizing oligonucleotides in accordance with conventional methods, by restriction enzyme digestion, by PCR amplification, etc. For the most part, DNA fragments will be of at least 15 nt, usually at least 18 nt or 25 nt, and may be at least about 50 nt.

A subject nucleic acid may comprise a nucleotide sequence encoding one or more of the following fragments of a subject sulfatase: a sulfatase domain; a G6S domain; and a coiled-coil domain. A subject nucleic acid may encode a fusion protein comprising one or more of the foregoing domains fused in-frame to a heterologous protein, as described above.

SULF nucleic acid molecules of the invention may comprise other, non-SULF nucleic acid molecules ("heterologous nucleic acid molecules") of any length. For example, the subject nucleic acid molecules may be flanked on the 5' and/or 3' ends by heterologous nucleic acid molecules of from about 1 nt to about 10 nt, from about 10 nt to about 20 nt, from about 20 nt to about 50 nt, from about 50 nt to about 100 nt, from about 100 nt to about 250 nt, from about 250 nt to about 500 nt, or from about 500 nt to about 1000 nt, or more in length. For example, when used as a probe to detect nucleic acid molecules capable of hybridizing with the subject nucleic acids, the subject nucleic acid molecules may be flanked by heterologous sequences of any length.

The subject nucleic acid molecules may also be provided as part of a vector (e.g., a SULF construct), a wide variety of which are known in the art and need not be elaborated upon herein. Vectors include, but are not limited to, plasmids; cosmids; viral vectors; artificial chromosomes (YAC's, BAC's, etc.); mini-chromosomes; and the like. Vectors are amply described in numerous publications well known to those in the art, including, e.g., Short Protocols in Molecular Biology, (1999) F. Ausubel, et al., eds., Wiley & Sons. Vectors may provide for expression of the subject nucleic acids, may provide for propagating the subject nucleic acids, or both.

The subject genes are isolated and obtained in substantial purity, generally as other than an intact chromosome. Usually, the DNA will be obtained substantially free of other nucleic acid sequences that do not include a sequence or fragment thereof of the subject genes, generally being at least about 50%, usually at least about 90% pure and are typically "recombinant", i.e. flanked by one or more nucleotides. With which it is not normally associated on a naturally occurring chromosome.

Preparation of the Subject Polypeptides

In addition to the plurality of uses described in greater detail in following sections, the subject nucleic acid compositions find use in the preparation of all or a portion of the sulfatase polypeptides of the subject invention, as described above. For expression, an expression cassette may be employed. The expression vector will provide a transcriptional and translational initiation region, which may be inducible or constitutive, where the coding region is operably linked under the transcriptional control of the transcriptional initiation region, and a transcriptional and translational termination region. These control regions may be native to a gene encoding the subject peptides, or may be derived from exogenous sources.

Expression vectors generally have convenient restriction sites located near the promoter sequence to provide for the insertion of nucleic acid sequences encoding heterologous proteins. A selectable marker operative in the expression host may be present. Expression vectors may be used for the production of fusion proteins, where the exogenous fusion peptide provides additional functionality, i.e. increased protein synthesis, stability, reactivity with defined antisera, an enzyme marker, e.g. β-galactosidase, etc.

Expression cassettes may be prepared comprising a transcription initiation region, the gene or fragment thereof, and a transcriptional termination region. Of particular interest is the use of sequences that allow for the expression of functional epitopes or domains, usually at least about 8 amino acids in length, more usually at least about 15 amino acids in length, to about 25 amino acids, or any of the above-described fragment, and up to the complete open reading frame of the gene. After introduction of the DNA, the cells containing the construct may be selected by means of a selectable marker, the cells expanded and then used for expression.

Proteins and polypeptides may be expressed in prokaryotes or eukaryotes in accordance with conventional ways, depending upon the purpose for expression. For large scale production of the protein, a unicellular organism, such as *E. coli, B. subtilis, S. cerevisiae*, insect cells in combination with baculovirus vectors, or cells of a higher organism such as vertebrates, particularly mammals, e.g. COS 7 cells, may be used as the expression host cells. In some situations, it is desirable to express the gene in eukaryotic cells, where the encoded protein will benefit from native folding and post-translational modifications. Small peptides can also be synthesized in the laboratory. Polypeptides that are subsets of the complete sequences of the subject proteins may be used to identify and investigate parts of the protein important for function.

Specific expression systems of interest include bacterial, yeast, insect cell and mammalian cell derived expression systems. Representative systems from each of these categories is are provided below:

Bacteria. Expression systems in bacteria include those described in Chang et al., *Nature* (1978) 275:615; Goeddel et al., *Nature* (1979) 281:544; Goeddel et al., *Nucleic Acids Res.* (1980) 8:4057; EP 0 036,776; U.S. Pat. No. 4,551,433; DeBoer et al., *Proc. Natl. Acad. Sci.* (USA) (1983) 80:21-25; and Siebenlist et al., *Cell* (1980) 20:269.

Yeast. Expression systems in yeast include those described in Hinnen et al, *Proc. Natl. Acad. Sci.* (USA) (1978) 75:1929; Ito et al., *J. Bacteriol.* (1983) 153:163; Kurtz et al., *Mol. Cell. Biol* (1986) 6:142; Kunze et al. *J. Basic Microbiol.* (1985) 25:141; Gleeson et al., *J. Gen. Microbiol.* (1986) 132:3459; Roggenkamp et al., *Mol. Gen. Genet* (1986) 202:302; Das et al., *J. Bacteriol.* (1984) 158:1165; De Louvencourt et al., *J. Bacteriol.* (1983) 154:737; Van den Berg et al., *Bio/Technology* (1990) 8:135; Kunze et al., *Basic Microbiol.* (1985) 25:141; Cregg et al, *Mol. Cell. Biol.* (1985) 5:3376; U.S. Pat. Nos. 4,837,148 and 4,929,555; Beach and Nurse, *Nature* (1981) 300:706; Davidow et al., *Curr. Genet.* (1985) 10:380; Gaillardin et al., *Curr. Genet.* (1985) 10:49; Ballance et al., *Biochem. Biophys. Res. Commun.* (1983) 112:284-289; Tilburn et al., *Gene* (1983) 26:205-221; Yelton et al., *Proc. Natl. Acad. Sci.* (*USA*) (1984) 81:1470-1474; Kelly and Hynes, *EMBO J.* (1985) 4:475-479; EP 0 244,234; and WO 91/00357.

Insect Cells. Expression of heterologous genes in insects is accomplished as described in U.S. Pat. No. 4,745,051; Friesen et al., "The Regulation of Baculovirus Gene Expression", in: *The Molecular Biology Of Baculoviruses* (1986) (W. Doerfler, ed.); EP 0 127,839; BP 0 155,476; and Vlak et al. *J. Gen. Virol.* (1988) 69:765-776; Miller et al., *Ann. Rev. Microbiol.* (1988) 42:177; Carbonell et al., *Gene* (1988) 73:409; Maeda et al., *Nature* (1985) S15:592-594; Lebacq-Verheyden et al., *Mol. Cell. Biol.* (1988) 8:3129; Smith et al., *Proc. Natl. Acad. Sci.* (*USA*) (1985) 82:8844; Miyajima et al., *Gene* (1987) 58:273; and Martin et al., *DNA* (1988) 7:99. Numerous baculoviral strains and variants and corresponding permissive insect host cells from hosts are described in Luckow et al., *Bio/Technology* (1988) 6:47-55, Miller et al., *Generic Engineering* (1986) 8:277-279, and Maeda et al., *Nature* (1985) 315:592-594.

Mammalian Cells. Mammalian expression is accomplished as described in Dijkema et al., *EMBO J.* (1985) 4:761, Gorman et al., *Proc. Natl. Acad Sci.* (*USA*) (1982) 79:6777, Boshart et al., *Cell* (1985) 41:521 and U.S. Pat. No. 4,399, 216. Other features of mammalian expression are facilitated as described in Ham and Wallace, *Meth. Enz.* (1979) 58:44, Barnes and Sato, *Anal Biochem.* (1980) 102:255, U.S. Pat. Nos. 4,767,704, 4,657,866, 4,927,762, 4,560,655, WO 90/103430, WO 87/00195, and U.S. RE 30,985.

When any of the above host cells, or other appropriate host cells or organisms, are used to replicate and/or express the polynucleotides or nucleic acids of the invention, the resulting replicated nucleic acid, RNA, expressed protein or polypeptide, is within the scope of the invention as a product of the host cell or organism. The product is recovered by any appropriate means known in the art.

Once the gene corresponding to a selected polynucleotide is identified, its expression can be regulated in the cell to which the gene is native. For example, an endogenous gene of a cell can be regulated by an exogenous regulatory sequence inserted into the genome of the cell at location sufficient to at least enhance expressed of the gene in the cell. The regulatory sequence may be designed to integrate into the genome via homologous recombination, as disclosed in U.S. Pat. Nos. 5,641,670 and 5,733,761, the disclosures of which are herein incorporated by reference, or may be designed to integrate into the genome via non-homologous recombination, as described in WO 99/15650, the disclosure of which is herein incorporated by reference. As such, also encompassed in the subject invention is the production of the subject proteins without manipulation of the encoding nucleic acid itself, but instead through integration of a regulatory sequence into the genome of cell that already includes a gene encoding the desired protein, as described in the above incorporated patent documents.

The subject proteins and polypeptides may be obtained from naturally occurring sources or synthetically produced. For example, the proteins may be derived from biological sources which express the proteins. The subject proteins may also be derived from synthetic means, e.g. by expressing a recombinant gene encoding protein of interest in a suitable host, as described in greater detail infra. Any convenient protein purification procedures may be employed, where suitable protein purification methodologies are described in Guide to Protein Purification, (Deuthser ed.) (Academic Press, 1990). For example, a lysate may prepared from the original source, (e.g. a cell expressing endogenous SULF1 or SULF2, or a cell comprising the expression vector expressing the subject polypeptide(s)), and purified using HPLC, exclusion chromatography, gel electrophoresis, affinity chromatography, and the like.

Compositions

The present invention further provides compositions, including pharmaceutical compositions, comprising the polypeptides, polynucleotides, antibodies, recombinant vectors, and host cells of the invention. These compositions may include a buffer, which is selected according to the desired use of the polypeptide, antibody, polynucleotide, recombinant vector, or host cell, and may also include other substances appropriate to the intended use. Those skilled in the art can readily select an appropriate buffer, a wide variety of which are known in the art, suitable for an intended use. In some instances, the composition can comprise a pharmaceutically acceptable excipient, a variety of which are known in the art and need not be discussed in detail herein. Pharmaceutically acceptable excipients have been amply described in a variety of publications, including, for example, A. Gennaro (1995) "Remington: The Science and Practice of Pharmacy", 19th edition, Lippincott, Williams, & Wilkins.

Antibodies Specific for a Sulfatase of the Invention

The invention provides antibodies that are specific for a subject sulfatase. Suitable antibodies are obtained by immunizing a host animal with peptides comprising all or a portion of the target protein. Suitable host animals include mouse, rat sheep, goat, hamster, rabbit, etc. The origin of the protein immunogen may be mouse, human, rat, monkey etc. The host animal will generally be a different species than the immunogen, e.g. human protein used to immunize mice, etc.

The immunogen may comprise the complete protein, or fragments and derivatives thereof. Preferred immunogens comprise all or a part of one of the subject proteins, where these residues contain the post-translation modifications, such as glycosylation, found on the native target protein. Immunogens comprising the extracellular domain are produced in a variety of ways known in the art, e.g. expression of cloned genes using conventional recombinant methods, isolation from tumor cell culture supernatants, etc.

The invention provides antibodies that are specific for a fragment of a subject sulfatase, or an epitope of a fragment. Fragments include, but are not limited to, a sulfatase domain; a G6S-related domain; and a coiled-coil domain, as described elsewhere herein. To generate antibodies specific for a particular domain, either the whole sulfatase polypeptide, or a portion thereof, can be used. For example, a fragment that corresponds to a sulfatase domain, a G6S-related domain, or a coiled-coil domain, is coupled to a carrier molecule (e.g., keyhole limpet hemocyanin, or other carrier), and introduced into a mammalian host.

For preparation of polyclonal antibodies, the first step is immunization of the host animal with the target protein, where the target protein will preferably be in substantially pure form, comprising less than about 1% contaminant. The immunogen may comprise the complete target protein, fragments or derivatives thereof. To increase the immune response of the host animal, the target protein may be combined with an adjuvant, where suitable adjuvants include alum, dextran, sulfate, large polymeric anions, oil & water emulsions, e.g. Freund's adjuvant, Freund's complete adjuvant, and the like. The target protein may also be conjugated to synthetic carrier proteins or synthetic antigens. A variety of hosts may be immunized to produce the polyclonal antibodies. Such hosts include rabbits, guinea pigs, rodents, e.g. mice, rats, sheep, goats, and the like. The target protein is administered to the host, usually intradermally, with an initial dosage followed by one or more, usually at least two, additional booster dosages. Following immunization, the blood from the host will be collected, followed by separation of the serum from the blood cells. The Ig present in the resultant antiserum may be further fractionated using known methods, such as ammonium salt fractionation, DEAE chromatography, and the like.

Monoclonal antibodies are produced by conventional techniques. Generally, the spleen and/or lymph nodes of an immunized host animal provide a source of plasma cells. The plasma cells are immortalized by fusion with myeloma cells to produce hybridoma cells. Culture supernatant from individual hybridomas is screened using standard techniques to identify those producing antibodies with the desired specificity. Suitable animals for production of monoclonal antibodies to the human protein include mouse, rat, hamster, etc. To raise antibodies against the mouse protein, the animal will generally be a hamster, guinea pig, rabbit, etc. The antibody may be purified from the hybridoma cell supernatants or ascites fluid by conventional techniques, e.g. affinity chromatography using protein according to the subject invention bound to an insoluble support, protein A sepharose, etc.

The antibody may be produced as a single chain, instead of the normal multimeric structure. Single chain antibodies are described in Jost et al (1994) *J.B.C.* 269:26267-73, and others. DNA sequences encoding the variable region of the heavy chain and the variable region of the light chain are ligated to a spacer encoding at least about 4 amino acids of small neutral amino acids, including glycine and/or serine. The protein encoded by this fusion allows assembly of a functional variable region that retains the specificity and affinity of the original antibody.

For in vivo use, particularly for injection into humans, it is desirable to decrease the antigenicity of the antibody. An immune response of a recipient against the blocking agent will potentially decrease the period of time that the therapy is effective. Methods of humanizing antibodies are known in the art. The humanized antibody may be the product of an animal having transgenic human immunoglobulin constant region genes (see for example International Patent Applications WO 90/10077 and WO 90/04036). Alternatively, the antibody of interest may be engineered by recombinant DNA techniques to substitute the CH1, CH2, CH3, hinge domains, and/or the framework domain with the corresponding human sequence (see WO 92/02190).

The use of Ig cDNA for construction of chimeric immunoglobulin genes is known in the art (Liu et al. (1987) *P.N.A.S.* 84:3439 and (1987) *J. Immunol.* 139:3521). mRNA is isolated from a hybridoma or other cell producing the antibody and used to produce cDNA. The cDNA of interest may be amplified by the polymerase chain reaction using specific primers (U.S. Pat. Nos. 4,683,195 and 4,683,202). Alternatively, a library is made and screened to isolate the sequence of interest. The DNA sequence encoding the variable region of the antibody is then fused to human constant region sequences. The sequences of human constant regions genes may be found in Kabat et al. (1991) *Sequences of Proteins of Immunological Interest*, N.I.H. publication no. 91-3242. Human C region genes are readily available from known clones. The choice of isotype will be guided by the desired effector functions, such as complement fixation, or activity in antibody-dependent cellular cytotoxicity. Preferred isotypes are IgG1, IgG3 and IgG4. Either of the human light chain constant regions, kappa or lambda, may be used. The chimeric, humanized antibody is then expressed by conventional methods.

In yet other embodiments, the antibodies may be fully human antibodies. For example, xenogeneic antibodies which are identical to human antibodies may be employed. By xenogenic human antibodies is meant antibodies that are the same has human antibodies, i.e. they are fully human antibodies, with exception that they are produced using a non-human host which has been genetically engineered to express human antibodies. See e.g. WO 98/50433; WO 98,24893 and WO 99/53049, the disclosures of which are herein incorporated by reference.

Antibody fragments, such as Fv, F(ab')$_2$ and Fab may be prepared by cleavage of the intact protein, e.g. by protease or chemical cleavage. Alternatively, a truncated gene is designed. For example, a chimeric gene encoding a portion of the F(ab')$_2$ fragment would include DNA sequences encoding the CH1 domain and hinge region of the H chain, followed by a translational stop codon to yield the truncated molecule.

Consensus sequences of H and L J regions may be used to design oligonucleotides for use as primers to introduce useful restriction sites into the J region for subsequent linkage of V region segments to human C region segments. C region cDNA can be modified by site directed mutagenesis to place a restriction site at the analogous position in the human sequence.

Expression vectors include plasmids, retroviruses, YACs, EBV derived episomes, and the like. A convenient vector is one that encodes a functionally complete human CH or CL immunoglobulin sequence, with appropriate restriction sites engineered so that any VH or VL sequence can be easily inserted and expressed. In such vectors, splicing usually occurs between the splice donor site in the inserted J region and the splice acceptor site preceding the human C region, and also at the splice regions that occur within the human CH exons. Polyadenylation and transcription termination occur at native chromosomal sites downstream of the coding regions.

The resulting chimeric antibody may be joined to any strong promoter, including retroviral LTRs, e.g. SV-40 early promoter, (Okayama et al. (1983) *Mol. Cell. Bio.* 3:280), Rous sarcoma virus LTR (Gorman et at (1982) *P.N.A.S.* 79:6777), and moloney murine leukemia virus LTR (Grosschedl et al. (1985) *Cell* 41:885); native Ig promoters, etc.

Uses of the Subject Polypeptide and Nucleic Acid Compositions

The subject polypeptide and nucleic acid compositions find use in a variety of different applications, including research, diagnostic, and therapeutic agent screening/discovery/preparation applications, as well as therapeutic compositions.

General Applications

The subject nucleic acid compositions find use in a variety of different applications. Applications of interest include: the identification of homologs of the subject sulfatases; as a source of novel promoter elements; the identification of expression regulatory factors; as probes and primers in hybridization applications, e.g. polymerase chain reaction (PCR); the identification of expression patterns in biological specimens; the preparation of cell or animal models for function of the subject sulfatases; the preparation of in vitro models for function of the subject sulfatases; etc.

Homologs are identified by any of a number of methods. A fragment of the provided cDNA may be used as a hybridization probe against a cDNA library from the target organism of interest, where low stringency conditions are used. The probe may be a large fragment, or one or more short degenerate primers. Nucleic acids having sequence similarity are detected by hybridization under low stringency conditions, for example, at 50° C. and 6×SSC (0.9 M sodium chloride/0.09 M sodium citrate) and remain bound when subjected to washing at 55° C. in 1×SSC (0.15 M sodium chloride/0.015 M sodium citrate). Sequence identity may be determined by hybridization under stringent conditions, for example, at 50° C. or higher and 0.1×SSC (15 mM sodium chloride/01.5 mM sodium citrate). Nucleic acids having a region of substantial identity to the provided nucleic acid sequences, e.g. allelic variants, genetically altered versions of the gene, etc., bind to the provided sequences under stringent hybridization conditions. By using probes, particularly labeled probes of DNA sequences, one can isolate homologous or related genes.

The sequence of the 5' flanking region may be utilized for promoter elements, including enhancer binding sites, that provide for developmental regulation in tissues where the subject genes are expressed. The tissue specific expression is useful for determining the pattern of expression, and for providing promoters that mimic the native pattern of expression. Naturally occurring polymorphisms in the promoter region are useful for determining natural variations in expression, particularly those that may be associated with disease.

Alternatively, mutations may be introduced into the promoter region to determine the effect of altering expression in experimentally defined systems. Methods for the identification of specific DNA motifs involved in the binding of transcriptional factors are known in the art, e.g. sequence similarity to known binding motifs, gel retardation studies, etc. For examples, see Blackwell et al. (1995), *Mol. Med.* 1:194-205; Mortlock et al. (1996), *Genome Res.* 6:327-33; and Joulin and Richard-Foy (1995), *Eur. J. Biochem.* 232:620-626.

The regulatory sequences may be used to identify cis acting sequences required for transcriptional or translational regulation of expression, especially in different tissues or stages of development, and to identify cis acting sequences and trans-acting factors that regulate or mediate expression. Such transcription or translational control regions may be operably linked to a gene in order to promote expression of wild type or proteins of interest in cultured cells, or in embryonic, fetal or adult tissues, and for gene therapy.

Small DNA fragments are useful as primers for PCR, hybridization screening probes, etc. Larger DNA fragments, i.e. greater than 100 nt are useful for production of the encoded polypeptide, as described in the previous section. For use in amplification reactions, such as PCR, a pair of primers will be used. The exact composition of the primer sequences is not critical to the invention, but for most applications the primers will hybridize to the subject sequence under stringent conditions, as known in the art. It is preferable to choose a pair of primers that will generate an amplification product of at least about 50 nt, preferably at least about 100 nt. Algorithms for the selection of primer sequences are generally known, and are available in commercial software packages. Amplification primers hybridize to complementary strands of DNA, and will prime towards each other.

The DNA may also be used to identify expression of the gene in a biological specimen. The manner in which one probes cells for the presence of particular nucleotide sequences, as genomic DNA or RNA, is well established in the literature. Briefly, DNA or mRNA is isolated from a cell sample. The mRNA may be amplified by RT-PCR, using reverse transcriptase to form a complementary DNA strand, followed by polymerase chain reaction amplification using primers specific for the subject DNA sequences. Alternatively, the mRNA sample is separated by gel electrophoresis, transferred to a suitable support, e.g. nitrocellulose, nylon, etc., and then probed with a fragment of the subject DNA as a probe. Other techniques, such as oligonucleotide ligation assays, in situ hybridizations, and hybridization to DNA probes arrayed on a solid chip may also find use. Detection of mRNA hybridizing to the subject sequence is indicative of gene expression in the sample.

The sequence of a gene according to the subject invention, including flanking promoter regions and coding regions, may be mutated in various ways known in the art to generate targeted changes in promoter strength, sequence of the encoded protein; etc. The DNA sequence or protein product of such a mutation will usually be substantially similar to the sequences provided herein, i.e. will differ by at least one nucleotide or amino acid, respectively, and may differ by at least two but not more than about ten nucleotides or amino acids. The sequence changes may be substitutions, insertions, deletions, or a combination thereof. Deletions may further include larger changes, such as deletions of a domain or exon. Other modifications of interest include epitope tagging, e.g. with the FLAG system, HA, etc. For studies of subcellular localization, fusion proteins with green fluorescent proteins (GFP) may be used.

Techniques for in vitro mutagenesis of cloned genes are known. Examples of protocols for site specific mutagenesis may be found in Gustin et al. (1993), *Biotechniques* 14:22; Barany (1985), *Gene* 37:111-23; Colicelli et al. (1985), *Mol. Gen. Genet.* 199:537-9; and Prentki et alt (1984), *Gene* 29:303-13. Methods for site specific mutagenesis can be found in Sambrook et al., *Molecular Cloning: A Laboratory Manual*, CSH Press 1989, pp. 15.3-15.108; Weiner et alt (1993), *Gene* 126:35-41; Sayers et al (1992), *Biotechniques* 13:592-6; Jones and Winistorfer (1992), *Biotechniques* 12:528-30; Barton et al. (1990), *Nucleic Acids Res* 18:7349-55; Marotti and Tomich (1989), *Gene Anal. Tech.* 6:67-70; and Zhu (1989), *Anal Biochem* 177:120-4. Such mutated genes may be used to study structure-function relationships of the subject proteins, or to alter properties of the protein that affect its function or regulation.

The subject nucleic acids can be used to generate transgenic, non-human animals or site-specific gene modifications in cell lines. Thus, in some embodiments, the invention provides a non-human transgenic animal comprising, as a transgene integrated into the genome of the animal, a nucleic acid molecule comprising a sequence encoding a subject sulfatase in operable linkage with a promoter, such that the sulfatase-encoding nucleic acid molecule is expressed in a cell of the animal. Transgenic animals may be made through homologous recombination, where the endogenous locus is altered. Alternatively, a nucleic acid construct is randomly integrated into the genome. Vectors for stable integration include plasmids, retroviruses and other animal viruses, YACs, and the like.

The modified cells or animals are useful in the study of gene function and regulation. For example, a series of small deletions and/or substitutions may be made in the host's native gene to determine the role of different exons in oncogenesis, signal transduction, etc. Of interest is the use of genes to construct transgenic animal models for cancer, where expression of the subject protein is specifically reduced or absent. Specific constructs of interest include antisense constructs, which will block expression, expression of dominant negative mutations, and over-expression of genes. Where a sequence is introduced, the introduced sequence may be either a complete or partial sequence of a gene native to the host, or may be a complete or partial sequence that is exogenous to the host animal, e.g., a human sequence of the subject invention. A detectable marker, such as lac Z may be introduced into the locus, where upregulation of expression will result in an easily detected change in phenotype.

One may also provide for expression of the gene, e.g. the SULF1 or SULF2 gene, or variants thereof in cells or tissues where it is not normally expressed, at levels not normally present in such cells or tissues, or at abnormal times of development. One may also generate host cells (including host cells in transgenic animals) that comprise a heterologous nucleic acid molecule which encodes a polypeptide which functions to modulate expression of an endogenous SULF1 or SULF2 promoter or other transcriptional regulatory region.

DNA constructs for homologous recombination will comprise at least a portion of the human gene or of a gene native to the species of the host animal, wherein the gene has the desired genetic modification(s), and includes regions of homology to the target locus. DNA constructs for random integration need not include regions of homology to mediate recombination. Conveniently, markers for positive and negative selection are included. Methods for generating cells having targeted gene modifications through homologous recombination are known in the art. For various techniques for transfecting mammalian cells, see Keown et al. (1990), *Meth. Enzymol.* 185:527-537.

For embryonic stem (ES) cells, an ES cell line may be employed, or embryonic cells may be obtained freshly from a host, e.g. mouse, rat, guinea pig, etc. Such cells are grown on an appropriate fibroblast-feeder layer or grown in the presence of leukemia inhibiting factor (LIF). When ES or embryonic cells have been transformed, they may be used to produce transgenic animals. After transformation, the cells are plated onto a feeder layer in an appropriate medium. Cells containing the construct may be detected by employing a selective medium. After sufficient time for colonies to grow, they are picked and analyzed for the occurrence of homologous recombination or integration of the construct. Those colonies that are positive may then be used for embryo manipulation and blastocyst injection. Blastocysts are obtained from 4 to 6 week old superovulated females. The ES cells are trypsinized, and the modified cells are injected into the blastocoel of the blastocyst. After injection, the blastocysts are returned to each uterine horn of pseudopregnant females. Females are then allowed to go to term and the resulting offspring screened for the construct. By providing for a different phenotype of the blastocyst and the genetically modified cells, chimeric progeny can be readily detected.

The chimeric animals are screened for the presence of the modified gene and males and females having the modification are mated to produce homozygous progeny. If the gene alterations cause lethality at some point in development, tissues or organs can be maintained as allogeneic or congenic grafts or transplants, or in in vitro culture. The transgenic animals may be any non-human mammal, such as laboratory animals, domestic animals, etc. The transgenic animals may be used in functional studies, drug screening, etc., e.g. to determine the effect of a candidate drug on SULF1 or SULF2 activity.

Any method of making transgenic animals can be used as described, for example, in *Transgenic Animal Generation and Use* L. M. Houdebine, Harwood Academic Press, 1997; *Transgenesis Techniques: Principles and Protocols* D. Murphy and D. A. Carter, ed. (June 1993) Humana Press; *Transgenic Animal Technology: A Laboratory Handbook* C. A. Pinkert, ed. (January 1994) Academic Press; *Transgenic Animals* F. Grosveld and G Kollias, eds. (July 1992) Academic Press; and *Embryonal Stem Cells: Introducing Planned Changes into the Animal Germline* M. L. Hooper (January 1993) Gordon & Breach Science Pub; U.S. Pat. No. 6,344, 596; U.S. Pat. No. 6,271,436; U.S. Pat. No. 6,218,596; and U.S. Pat. No. 6,204,431; Maga and Murray (1995) *Bio/Technol.* 13:1452-1457; Ebert et al. (1991) *Bio/Technol.* 9:835-838; Velander et al. (1992) *Proc. Natl. Acad, Sci. USA* 89:12003-12007; Wright et al. (1991) *Bio/Technol.* 9:830-834.

Diagnostic Applications

Also provided are methods of diagnosing disease states based on observed levels and/or activity of the subject sulfatase(s) and/or the level of a subject sulfatase polynucleotide in a biological sample of interest. Samples, as used herein, include biological fluids such as blood, cerebrospinal fluid, tears, saliva, lymph, dialysis fluid, breast ductal lavage fluid, semen and the like; cells; organ or tissue culture derived fluids; tumor biopsy samples; stool samples; and fluids extracted from physiological tissues. Also included in the term are derivatives and fractions of such fluids. The cells may be dissociated, in the case of solid tissues, or tissue sections may be analyzed. Alternatively a lysate of the cells may be prepared.

Assay methods of the invention may be qualitative or quantitative. Thus, as used herein, the terms "detection," "determination," and the like, refer to both qualitative and quantitative determinations, and include "measuring."

Detection methods of the present invention include methods for detecting sulfatase polypeptide in a biological sample, methods for detecting sulfatase mRNA in a biological sample, and methods for detecting sulfatase enzymatic activity in a biological sample.

In some embodiments, the detection methods provide for detection of cancerous cells in a biological sample (e.g., a tissue biopsy). As described in the Examples, huSULF-1 rRNA levels are elevated in particular cancers, e.g., pancreatic cancer and prostate cancer; and huSULF-2 mRNA levels are elevated in breast cancer. Thus, detection of an mRNA encoding huSULF-1 or huSULF-2 at an elevated level compared to normal (non-cancerous) tissue, provides for detection of cancerous tissue in a biological sample.

Detection Kits

The detection methods can be provided as part of a kit. Thus, the invention further provides kits for detecting the presence and/or a level of sulfatase polypeptide or sulfatase polynucleotide in a biological sample. Procedures using these kits can be performed by clinical laboratories, experimental laboratories, medical practitioners, or private individuals. The kits of the invention for detecting a sulfatase polypeptide comprise a moiety that specifically binds sulfatase, including, but not limited to, a sulfatase-specific antibody. The kits of the invention for detecting a sulfatase polynucleotide comprise a moiety that specifically hybridizes to a sulfatase polynucleotide.

In some embodiments, a kit of the invention for detecting a sulfatase polynucleotide, such as an mRNA encoding a subject sulfatase, comprises a pair of nucleic acids that function as "forward" and "reverse" primers that specifically amplify a cDNA copy of a subject sulfatase-encoding mRNA. The "forward" and "reverse" primers are provided in the kit as a pair of isolated nucleic acid molecules, each from about 10 to 200 nucleotides in length, the first nucleic acid molecule of the pair comprising a sequence of at least 10 contiguous nucleotides having 100% sequence identity to the nucleic acid sequence set forth in any one of SEQ ID NO:02, 05, or 14, and the second nucleic acid molecule of the pair comprising a sequence of at least 10 contiguous nucleotides having 100% sequence identity to the reverse complement of the nucleic acid sequence set forth in any one of SEQ ID NO:02, 05, or 14, wherein the sequence of the second nucleic acid molecule is located 3' of the nucleic acid sequence of the first nucleic acid molecule in any one of SEQ ID NO:02, 05, or 14. The primer nucleic acids are prepared using any known method, e.g., automated synthesis, and the like.

The invention provides a kit comprising a pair of nucleic acids as described above. The nucleic acids are present in a suitable storage medium, e.g., buffered solution, typically in a suitable container. The kit includes the pair of nucleic acids, and may further include a buffer; reagents for polymerase chain reaction (e.g., deoxynucleotide triphosphates (dATP, dTTP, dCTP, and dGTP), a thermostable DNA polymerase, a buffer suitable for polymerase chain reaction, a solution containing $Mg^{2+}$ ions (e.g., $MgCl_2$), and other components well known to those skilled in the art for carrying out a polymerase chain reaction). The kit may further include instructions for use of the kit, which instructions may be provided in a variety of forms, e.g., as printed information, on a compact disc, and the like. The kit may further include reagents necessary for extraction of DNA from a biological sample (e.g., biopsy sample, blood, and the like) from an individual, and reagents for generating a cDNA copy of an mRNA. The kits are useful in diagnostic applications, as described in more detail below. The pair of isolated nucleic acid molecules serve as primers in an amplification reaction (e.g., a polymerase chain reaction).

In some embodiments, the first and/or the second nucleic acid molecules comprises a detectable label. Suitable labels include fluorochromes, e.g. fluorescein isothiocyanate (FITC), rhodamine, Texas Red, phycoerythrin, allophycocyanin, 6-carboxyfluorescein (6-FAM), 2',7'-dimethoxy-4',5'-dichloro-6-carboxyfluorescein (JOE), 6-carboxy-X-rhodamine (ROX), 6-carboxy-2',4',7',4,7-hexachlorofluorescein (HEX), 5-carboxyfluorescein (5-FAM) or N,N,N',N'-tetramethyl-6-carboxyrhodamine (TAMRA), radioactive labels, e.g. $^{32}P$, $^{35}S$, $^{3}H$; etc. The label may be a two stage system, where the amplified DNA is conjugated to biotin, haptens, etc. having a high affinity binding partner, e.g. avidin, specific antibodies, etc., where the binding partner is conjugated to a detectable label. The label may be conjugated to one or both of the primers. Alternatively, the pool of nucleotides used in the amplification is labeled, so as to incorporate the label into the amplification product.

The kit may optionally provide additional components that are useful in the procedure, including, but not limited to, buffers, developing reagents, labels, reacting surfaces, means for detections, control samples, standards, instructions, and interpretive information.

Where the kit provides for detection of a subject sulfatase polypeptide, the kit includes one or more antibodies specific for the subject sulfatase. In some embodiments, the antibody specific for the subject sulfatase is detectably labeled. In other embodiments, the antibody specific for the subject sulfatase is not labeled; instead, a second, detectably-labeled antibody is provided that binds to the antibody specific for a subject sulfatase (the "first" antibody). The kit may further include blocking reagents, buffers, and reagents for developing and/ or detecting the detectable marker. The kit may further include instructions for use, controls, and interpretive information.

Where the kit provides for detecting enzymatic activity of a subject sulfatase, the kit includes a substrate that provides for a detectable product when acted upon by a subject sulfatase. Suitable substrates are discussed in detail below. One non-limiting example of a suitable substrate is 4-methylumbelliferyl-sulfate. The kit may further include reagents necessary for detectable marker development and detection. The kit may further include instructions for use, controls, and interpretive information.

Methods of Detecting a Sulfatase Polypeptide in a Biological Sample

The present invention further provides methods for detecting the presence and/or measuring a level of a sulfatase polypeptide in a biological sample, using a sulfatase-specific antibody. The methods generally comprise:

a) contacting the sample with an antibody specific for a sulfatase polypeptide; and b) detecting binding between the antibody and molecules of the sample.

Detection of specific binding of the sulfatase-specific antibody, when compared to a suitable control, is an indication that sulfatase polypeptides are present in the sample. Suitable controls include a sample known not to contain a sulfatase polypeptide; and a sample contacted with an antibody not specific for sulfatase, e.g., an anti-idiotype, antibody. A variety of methods to detect specific antibody-antigen interactions are known in the art and can be used in the method, including, but not limited to, standard immunohistological methods, immunoprecipitation, an enzyme immunoassay, and a radioimmunoassay. In general, the sulfatase-specific antibody will be detectably labeled, either directly or indirectly. Direct labels include radioisotopes; enzymes whose products are detectable (e.g., luciferase, β-galactosidase, and the like); fluorescent labels (e.g., fluorescein isothiocyanate, rhodamine, phycoerythrin, and the like); fluorescence emitting metals, e.g., $^{152}$Eu, or others of the lanthanide series, attached to the antibody through metal chelating groups such as EDTA; chemiluminescent compounds, e.g., luminol, isoluminol, acridinium salts, and the like; bioluminescent compounds, e.g., luciferin, aequorin (green fluorescent protein), and the like.

The antibody may be attached (coupled) to an insoluble support, such as a polystyrene plate or a bead. Indirect labels include second antibodies specific for sulfatase-specific antibodies, wherein the second antibody is labeled as described above; and members of specific binding pairs, e.g., biotin-avidin, and the like. The biological sample may be brought into contact with an immobilized on a solid support or carrier, such as nitrocellulose, that is capable of immobilizing cells, cell particles, or soluble proteins. The support may then be washed with suitable buffers, followed by contacting with a detectably-labeled sulfatase-specific antibody. Detection methods are known in the art and will be chosen as appropriate to the signal emitted by the detectable label. Detection is generally accomplished in comparison to suitable controls, and to appropriate standards.

Methods of Detecting Enzymatic Activity of a Subject Sulfatase in a Biological Same The present invention further provides methods for detecting the presence and/or levels of enzymatic activity of a subject sulfatase in a biological sample. The methods generally involve:

a) contacting the sample with a substrate that yields a detectable product upon being acted upon by a subject sulfatase; and b) detecting a product of the enzymatic reaction.

Any sulfated compound that, upon cleavage of the sulfate group by the sulfatase activity, results in a change in absorption, fluorescence or other physical property amenable to detection, is suitable for use in a subject assay. Suitable substrates include, but are not limited to, 4-methylumbelliferyl sulfate; p-nitrophenyl sulfate; 4-methylumbelliferyl-α-D-N-acetylglucosamide-6-sulfate or 4-methylumbelliferyl-glucosamine-6-sulfate or conjugates containing these derivatives; any sulfated sugar or assembly of sugars related to heparan sulfate, including fragments of heparin or heparan sulfate; and any sulfated compound in which the sulfate is radiolabeled.

Methods of Detecting a Sulfatase mRNA in a Biological Sample

The present invention further provides methods for detecting the presence of sulfatase mRNA in a biological sample. The methods can be used, for example, to assess whether a test compound affects sulfatase gene expression, directly or indirectly.

The methods generally comprise:

a) contacting the sample with a sulfatase polynucleotide of the invention under conditions which allow hybridization; and b) detecting hybridization, if any.

Detection of hybridization, when compared to a suitable control, is an indication of the presence in the sample of a sulfatase polynucleotide. Appropriate controls include, for example, a sample which is known not to contain sulfatase mRNA, and use of a labelled polynucleotide of the same "sense" as a sulfatase mRNA. Conditions which allow hybridization are known in the art, and have been described in more detail above. Detection can be accomplished by any known method, including, but not limited to, in situ hybridization, PCR, RT-PCR, and "Northern" or RNA blotting, or combinations of such techniques, using a suitably labelled sulfatase polynucleotide. A variety of labels and labelling methods for polynucleotides are known in the art and can be used in the assay methods of the invention. Specific hybridization can be determined by comparison to appropriate controls.

In some embodiments, the methods involve generating a cDNA copy of an mRNA molecule in a biological sample, and amplifying the cDNA using a pair of isolated nucleic acid molecules that serve as forward and reverse primers in an amplification reaction (e.g., a polymerase chain reaction).

Each of the nucleic acid molecules in the pair of nuclei acid molecules is from about 10 to 200 nucleotides in length, the first nucleic acid molecule of the pair comprising a sequence of at least 10 contiguous nucleotides having 100% sequence identity to the nucleic acid sequence set forth in any one of SEQ ID NO:02, 05, or 14, and the second nucleic acid molecule of the pair comprising a sequence of at least 10 contiguous nucleotides having 100% sequence identity to the reverse complement of the nucleic acid sequence set forth in any one of SEQ ID NO:02, 05, or 14, wherein the sequence of the second nucleic acid molecule is located 3' of the nucleic acid sequence of the first nucleic acid molecule in any one of SEQ ID NO:02, 05, or 14. The primer nucleic acids are prepared using any known method, e.g., automated synthesis, and the like. The primer pairs are chosen such that they specifically amplify a cDNA copy of an mRNA encoding a subject sulfatase.

Methods using PCR amplification can be performed on the DNA from a single cell, although it is convenient to use at least about $10^5$ cells. The use of the polymerase chain reaction is described in Saiki et al. (1985) *Science* 239:487, and a review of current techniques may be found in Sambrook, et al. *Molecular Cloning: A Laboratory Manual*, CSH Press 1989, pp. 14.2B14.33. A detectable label may be included in the amplification reaction. Suitable labels include fluorochromes, e.g. fluorescein isothiocyanate (FITC), rhodamine, Texas Red, phycoerythrin, allophycocyanin, 6-carboxyfluorescein (6-FAM), 2',7'-dimethoxy-4',5'-dichloro-6-carboxyfluorescein (JOE), 6-carboxy-X-rhodamine (ROX), 6-carboxy-2',4',7',4,7-hexachlorofluorescein (HEX), 5-carboxyfluorescein (5-FAM) or N,N,N',N'-tetramethyl-6-carboxyrhodamine (TAMRA), radioactive labels, e.g. $^{32}P$, $^{35}S$, $^3H$; etc. The label may be a two stage system, where the amplified DNA is conjugated to biotin, haptens, etc. having a high affinity binding partner, e.g. avidin, specific antibodies, etc., where the binding partner is conjugated to a detectable label. The label may be conjugated to one or both of the primers. Alternatively, the pool of nucleotides used in the amplification is labeled, so as to incorporate the label into the amplification product.

A number of methods are available for determining the expression level of a gene or protein in a particular sample. Diagnosis may be performed by a number of methods to determine the absence or presence or altered amounts of normal or abnormal sulfatase in a patient sample. For example, detection may utilize staining of cells or histological sections with labeled antibodies, performed in accordance with conventional methods. Cells are permeabilized to stain cytoplasmic molecules. The antibodies of interest are added to the cell sample, and incubated for a period of time sufficient to allow binding to the epitope, usually at least about 10 minutes. The antibody may be labeled with radioisotopes, enzymes, fluorescers, chemiluminescers, or other labels for direct detection. Alternatively, a second stage antibody or reagent is used to amplify the signal. Such reagents are well known in the art. For example, the primary antibody may be conjugated to biotin, with horseradish peroxidase-conjugated avidin added as a second stage reagent. Alternatively, the secondary antibody conjugated to a fluorescent compound, e.g. fluorescein, rhodamine, Texas red, etc. Final detection uses a substrate that undergoes a color change in the presence of the peroxidase. The absence or presence of antibody binding may be determined by various methods, including flow cytometry of dissociated cells, microscopy, radiography, scintillation counting, etc.

Alternatively, one may focus on the expression of the subject sulfatase genes. Biochemical studies may be performed to determine whether a sequence polymorphism in a coding region or control regions is associated with disease. Disease associated polymorphisms may include deletion or truncation of the gene, mutations that alter expression level, that affect the activity of the protein, etc.

Changes in the promoter or enhancer sequence that may affect expression levels of the subject genes can be compared to expression levels of the normal allele by various methods known in the art. Methods for determining promoter or enhancer strength include quantitation of the expressed natural protein; insertion of the variant control element into a vector with a reporter gene such as β-galactosidase, luciferase, chloramphenicol acetyltransferase, etc. that provides for convenient quantitation; and the like.

A number of methods are available for analyzing nucleic acids for the presence of a specific sequence, e.g. a disease associated polymorphism. Where large amounts of DNA are available, genomic DNA is used directly. Alternatively, the region of interest is cloned into a suitable vector and grown in sufficient quantity for analysis. Cells that express the gene may be used as a source of mRNA, which may be assayed directly or reverse transcribed into cDNA for analysis. The nucleic acid may be amplified by conventional techniques, such as the polymerase chain reaction (PCR), to provide sufficient amounts for analysis. The use of the polymerase chain reaction is described in Saiki, et al. (1985), *Science* 239:487, and a review of techniques may be found in Sambrook, et at. *Molecular Cloning: A Laboratory Manual*, CSH Press 1989, pp. 14.2-14.33. Alternatively, various methods are known in the art that utilize oligonucleotide ligation as a means of detecting polymorphisms, for examples see Riley et al (1990), *Nucl. Acids Res.* 18:2887-2890; and Delahunty et al (1996), *Am. J. Hum. Genet.* 58:1239-1246.

A detectable label may be included in an amplification reaction. Suitable labels include fluorochromes, e.g. fluorescein isothiocyanate (FITC), rhodamine, Texas Red, phycoerythrin, allophycocyanin, 6-carboxyfluorescein (6-FAM), 2',7'-dimethoxy-4',5'-dichloro-6-carboxyfluorescein (JOE), 6-carboxy-X-rhodamine (ROX), 6-carboxy-2',4',7',4,7-hexachlorofluorescein (HEX), 5-carboxyfluorescein (5-FAM) or N,N,N',N'-tetramethyl-6-carboxyrhodamine (TAMRA), radioactive labels, e.g. $^{32}P$, $^{35}S$, $^3H$; etc. The label may be a two stage system, where the amplified DNA is conjugated to biotin, haptens, etc. having a high affinity binding partner, e.g. avidin, specific antibodies, etc., where the binding partner is conjugated to a detectable label. The label may be conjugated to one or both of the primers. Alternatively, the pool of nucleotides used in the amplification is labeled, so as to incorporate the label into the amplification product.

The sample nucleic acid, e.g. amplified or cloned fragment, is analyzed by one of a number of methods known in the art. The nucleic acid may be sequenced by dideoxy or other methods, and the sequence of bases compared to a wild-type sequence. Hybridization with the variant sequence may also be used to determine its presence, by Southern blots, dot blots, etc. The hybridization pattern of a control and variant sequence to an array of oligonucleotide probes immobilized on a solid support, as described in U.S. Pat. No. 5,445,934, or in WO 95/35505, may also be used as a means of detecting the presence of variant sequences. Single strand conformational polymorphism (SSCP) analysis, denaturing gradient gel electrophoresis (DGGE), and heteroduplex analysis in gel matrices are used to detect conformational changes created by DNA sequence variation as alterations in electrophoretic mobility. Alternatively, where a polymorphism creates or destroys a recognition site for a restriction endonuclease, the sample is digested with that endonuclease, and the products size fractionated to determine whether the fragment was digested. Fractionation is performed by gel or capillary electrophoresis, particularly acrylamide or agarose gels.

Screening for mutations in the gene may be based on the functional or antigenic characteristics of the protein. Protein truncation assays are useful in detecting deletions that may affect the biological activity of the protein. Various immunoassays designed to detect polymorphisms in proteins may be used in screening. Where many diverse genetic mutations lead to a particular disease phenotype, functional protein assays have proven to be effective screening tools. The activity of the encoded protein may be determined by comparison with the wild-type protein.

Diagnostic methods of the subject invention in which the level of expression is of interest will typically involve comparison of the nucleic acid abundance of a sample of interest with that of a control value to determine any relative differences, where the difference may be measured qualitatively and/or quantitatively, which differences are then related to the presence or absence of an abnormal expression pattern. A variety of different methods for determining the nucleic acid abundance in a sample are known to those of skill in the art, where particular methods of interest include those described in: Pieta et al., Genome Res. (June 1996) 6: 492-503; Zhao et al., Gene (Apr. 24, 1995) 156: 207-213; Soares, Curr. Opin. Biotechnol. (October 1997) 8: 542-546; Raval, J. Pharmacol Toxicol Methods (November 1994) 32: 125-127; Chalifour et al., Anal. Biochem (Feb. 1, 1994) 216: 299-304; Stolz & Tuan, Mol. Biotechnol. (December 19960 6: 225-230; Hong et al., Bioscience Reports (1982) 2: 907; and McGraw, Anal. Biochem. (1984) 143: 298. Also of interest are the methods disclosed in WO 97/27317, the disclosure of which is herein incorporated by reference.

Screening Assays

The present invention provides in vitro screening methods. The screening methods include methods for identifying agents which modulate sulfatase enzyme activity, methods for identifying agents which modulate a level of a subject sulfatase polypeptide in a cell; and methods for identifying agents which modulate a level of a subject sulfatase mRNA in a cell; methods for identifying an agent that modulates substrate recognition by a subject sulfatase; methods for identifying an agent that reduces binding of a coiled-coil domain of a subject sulfatase with a second protein; and methods for identifying agents that modulate release of a subject sulfatase from a eukaryotic cell. In some embodiments, the assay is a cell-free assay. In other embodiments, the assay is a cell-based assay.

As used herein, the term "modulate" encompasses "increase" and "decrease." In some embodiments, of particular interest are agents which inhibit sulfatase activity, and/or which reduce a level of a subject sulfatase polypeptide in a cell, and/or which reduce a level of a subject sulfatase mRNA in a cell and/or which reduce release of a subject sulfatase from a eukaryotic cell. Such agents are of interest as candidates for treating cancers. In other embodiments, agents of interest are those that increase sulfatase activity; such agents are of interest as candidates for treating disorders amenable to treatment by increasing angiogenesis, e.g., ischemic conditions.

The terms "candidate agent," "test agent," "agent", "substance" and "compound" are used interchangeably herein. Candidate agents encompass numerous chemical classes, typically synthetic, semi-synthetic, or naturally-occurring inorganic or organic molecules. Candidate agents may be small organic compounds having a molecular weight of more than 50 and less than about 2,500 daltons. Candidate agents may comprise functional groups necessary for structural interaction with proteins, particularly hydrogen bonding, and may include at least an amine, carbonyl, hydroxyl or carboxyl group, and may contain at least two of the functional chemical groups. The candidate agents may comprise cyclical carbon or heterocyclic structures and/or aromatic or polyaromatic structures substituted with one or more of the above functional groups. Candidate agents are also found among biomolecules including peptides, saccharides, fatty acids, steroids, purines, pyrimidines, derivatives, structural analogs or combinations thereof.

Candidate agents are obtained from a wide variety of sources including libraries of synthetic or natural compounds. For example, numerous means are available for random and directed synthesis of a wide variety of organic compounds and biomolecules, including expression of randomized oligonucleotides and oligopeptides. Alternatively, libraries of natural compounds in the form of bacterial, fungal, plant and animal extracts are available or readily produced. Additionally, natural or synthetically produced libraries and compounds are readily modified through conventional chemical, physical and biochemical means, and may be used to produce combinatorial libraries. Known pharmacological agents may be subjected to directed or random chemical modifications, such as acylation, alkylation, esterification, aridification, etc. to produce structural analogs.

Where the screening assay is a binding assay, one or more of the molecules may be joined to a label, where the label can directly or indirectly provide a detectable signal. Various labels include radioisotopes, fluorescers, chemiluminescers, enzymes, specific binding molecules, particles, e.g. magnetic particles, and the like. Specific binding molecules include pairs, such as biotin and streptavidin, digoxin and antidigoxin etc. For the specific binding members, the complementary member would normally be labeled with a molecule that provides for detection, in accordance with known procedures.

A variety of other reagents may be included in the screening assay. These include reagents like salts, neutral proteins) e.g. albumin, detergents, etc that are used to facilitate optimal protein-protein binding and/or reduce non-specific or background interactions. Reagents that improve the efficiency of the assay, such as protease inhibitors, nuclease inhibitors, anti-microbial agents, etc. may be used. The mixture of components are added in any order that provides for the requisite binding. Incubations are performed at any suitable temperature, typically between 4° C. and 40° C. Incubation periods are selected for optimum activity, but may also be optimized to facilitate rapid high-throughput screening. Typically between 0.1 and 1 hour will be sufficient.

A variety of other reagents may be included in the screening assay. These include reagents like salts, neutral proteins, e.g. albumin, detergents, etc that are used to facilitate optimal protein-protein binding and/or reduce non-specific or background interactions. Reagents that improve the efficiency of the assay, such as protease inhibitors, nuclease inhibitors, anti-microbial agents, etc. may be used.

The screening methods may be designed a number of different ways, where a variety of assay configurations and protocols may be employed, as are known in the art. For example, one of the components may be bound to a solid support, and the remaining components contacted with the support bound component. The components of the method may be combined at substantially the same time or at different times. Incubations are performed at any suitable temperature, typically between 4 and 40° C. Incubation periods are selected for optimum activity, but may also be optimized to facilitate rapid high-throughput screening. Typically between 0.1 and 1 hours will be sufficient. Following the contact and incubation steps, the subject methods will generally, though not necessarily, further include a washing step to remove unbound components, where such a washing step is generally employed when required to remove label that would give rise to a background signal during detection, such as radioactive or fluorescently labeled non-specifically bound components. Following the optional washing step, the presence of bound complexes will then be detected.

Generally a plurality of assays are run in parallel with different agent concentrations to obtain a differential response to the various concentrations. Typically, one of these concentrations serves as a negative control, i.e. at zero concentration or below the level of detection.

Methods for Identifying Agents that Modulate Sulfatase Activity

The present invention provides methods of identifying agents that modulate an enzymatic activity of a sulfatase polypeptide of the invention. In many embodiments, the methods are in vitro cell-free methods. The term "modulate", encompasses an increase or a decrease in the measured sulfatase activity when compared to a suitable control.

The method generally comprises:
a) contacting a test agent with a sample containing a sulfatase polypeptide; and
b) assaying a sulfatase activity of the sulfatase polypeptide in the presence of the substance. An increase or a decrease in sulfatase activity in comparison to sulfatase activity in a suitable control (e.g., a sample comprising a sulfatase polypeptide in the absence of the substance being tested) is an indication that the substance modulates an enzymatic activity of the sulfatase.

An "agent which modulates a sulfatase activity of a sulfatase polypeptide", as used herein, describes any molecule, e.g. synthetic or natural organic or inorganic compound, protein or pharmaceutical, with the capability of altering a sulfatase activity of a sulfatase polypeptide, as described herein. Generally a plurality of assay mixtures is run in parallel with different agent concentrations to obtain a differential response to the various concentrations. Typically, one of these concentrations serves as a negative control, i.e. at zero concentration or below the level of detection. Sulfatase activity can be measured using any sulfatase assay known in the art.

In many embodiments, the methods are in vitro cell-free methods. The sulfatase polypeptide may be, but need not be, purified in carrying out the methods. The sulfatase may be a full-length sulfatase polypeptide; a fragment that retains sulfatase activity (e.g., a sulfatase domain); or fusion polypeptide that includes a sulfatase domain and a heterologous protein.

Any sulfated compound that, upon cleavage of the sulfate group by the sulfatase activity, results in a change in absorption, fluorescence or other physical property amenable to detection, is suitable for use in a subject assay. Suitable substrates include, but are not limited to, 4-methylumbelliferyl sulfate; p-nitrophenyl sulfate; 4-methylumbelliferyl-α-D-N-acetylglucosamide-6-sulfate or 4-methylumbelliferyl-glucosamine-6-sulfate or conjugates containing these derivatives; any sulfated sugar or assembly of sugars related to heparan sulfate, including fragments of heparin or heparan sulfate; and any sulfated compound in which the sulfate is radiolabeled.

In certain embodiments, a substrate comprising a $^{35}S$ label is used. Release of $^{35}S$ is measured using any appropriate assay, e.g., scintillation counting, and the like.

In other embodiments, the substrate comprises a sulfated moiety that provides a detectable signal once the sulfate is released by action of the sulfatase. In a particular embodiment, the substrate is 4-methylumbelliferyl-sulfate. The reaction product of the action of a subject sulfatase on 4-methylumbelliferyl sulfate is 4-methylumbelliferone, which is a fluorescent compound. The product 4-methylumbelliferone is detected by an excitation wavelength of about 360 nm, whereupon the product emits at about 460 nm. Generally, the reaction includes 4-methylumbelliferyl-sulfate at about 10 mM, and 10 mM lead acetate. The reaction is carried out at 37° C. If desired, the reaction is stopped by addition of an excess of 0.5 M $Na_2CO_3/NaHCO_3$, pH 10.7. Sulfatase activity is detected by measuring fluorescence. This assay is particularly suited to a high through-put format.

An agent which modulates a sulfatase activity of a subject polypeptide increases or decreases the activity at least about 10%, at least about 15%, at least about 20%, at least about 25%, more preferably at least about 50%, more preferably at least about 100%, or 2-fold, more preferably at least about 5-fold, more preferably at least about 10-fold or more when compared to a suitable control.

Agents that increase or decrease a sulfatase activity of a subject polypeptide to the desired extent may be selected for further study, and assessed for cellular availability, cytotoxicity, biocompatibility, etc.

Of particular interest in some embodiments are agents that decrease a sulfatase activity of a subject polypeptide. Maximal inhibition of sulfatase activity is not always necessary, or even desired, in every instance to achieve a therapeutic effect. Agents which decrease a sulfatase activity of a subject polypeptide may find use in reducing angiogenesis stimulated by a tumor cell and thus may be useful in treating cancers.

Of particular interest in some embodiments are agents that increase a sulfatase activity of a subject polypeptide. Agents which increase a sulfatase activity of a subject polypeptide may find use in increasing angiogenesis and thus may be useful in treating ischemic conditions.

Cell-Based Methods

Cell-based methods include methods of detecting an agent that modulates a level of a subject sulfatase mRNA and/or subject sulfatase polypeptides, and methods for detecting an agent that modulates release of a subject sulfatase from a eukaryotic cell.

A candidate agent is assessed for any cytotoxic activity it may exhibit toward the cell used in the assay, using well-known assays, such as trypan blue dye exclusion, an MTT ([3-(4,5-dimethylthiazol-2-yl)-2,5-diphenyl-2H-tetrazolium bromide]) assay, and the like. Agents that do not exhibit cytotoxic activity are considered candidate agents.

The cells used in the assay are usually mammalian cells, including, but not limited to, rodent cells and human cells. The cells may be primary cell cultures or may be immortalized cell lines.

Methods of Detecting Agents that Modulate a Level of Sulfatase mRNA and/or Sulfatase Polypeptide A wide variety of cell-based assays may be used for identifying agents which modulate levels of sulfatase mRNA and for identifying agents that modulate release of a sulfatase from a eukaryotic cell, using, for example, a mammalian cell transformed with a construct comprising a sulfatase-encoding cDNA such that the cDNA is overexpressed, or, alternatively, a construct comprising a sulfatase promoter operably linked to a reporter gene.

Accordingly, the present invention provides a method for identifying an agent, particularly a biologically active agent, that modulates a level of sulfatase expression in a cell, the method comprising: combining a candidate agent to be tested with a cell comprising a nucleic acid which encodes a sulfatase polypeptide; and determining the effect of said agent on sulfatase expression. "Modulation" of sulfatase expression levels includes increasing the level and decreasing the level of sulfatase mRNA and/or sulfatase polypeptide encoded by the sulfatase polynucleotide when compared to a control lacking the agent being tested. An increase or decrease of about 1.25-fold, usually at least about 1.5-fold, usually at least about 2-fold, usually at least about 5-fold, usually at least about 10-fold or more, in the level (i.e., an amount) of sulfatase mRNA and/or polypeptide following contacting the cell with a candidate agent being tested, compared to a control to which no agent is added, is an indication that the agent modulates sulfatase expression.

Sulfatase mRNA and/or polypeptide whose levels are being measured can be encoded by an endogenous sulfatase polynucleotide, or the sulfatase polynucleotide can be one that is comprised within a recombinant vector and introduced into the cell, i.e., the sulfatase mRNA and/or polypeptide can be encoded by an exogenous sulfatase polynucleotide. For example, a recombinant vector may comprise an isolated sulfatase transcriptional regulatory sequence, such as a promoter sequence, operably linked to a reporter gene (e.g., β-galactosidase, CAT, luciferase, or other gene that can be easily assayed for expression). In these embodiments, the method for identifying an agent that modulates a level of sulfatase expression in a cell, comprises: combining a candidate agent to be tested with a cell comprising a nucleic acid which comprises a sulfatase gene transcriptional regulatory element operably linked to a reporter gene; and determining the effect of said agent on reporter gene expression. A recombinant vector may comprise an isolated sulfatase transcriptional regulatory sequence, such as a promoter sequence, operably linked to sequences coding for a sulfatase polypeptide; or the transcriptional control sequences can be operably linked to coding sequences for a sulfatase fusion protein comprising sulfatase polypeptide fused to a polypeptide which facilitates detection. In these embodiments, the method comprises combining a candidate agent to be tested with a cell comprising a nucleic acid which comprises a sulfatase gene transcriptional regulatory element operably linked to a sulfatase polypeptide-coding sequence; and determining the effect of said agent on sulfatase expression, which determination can be carried out by measuring an amount of sulfatase mRNA, sulfatase polypeptide, or sulfatase fusion polypeptide produced by the cell.

Cell-based assays generally comprise the steps of contacting the cell with an agent to be tested, forming a test sample, and, after a suitable time, assessing the effect of the agent on sulfatase expression. A control sample comprises the same cell without the candidate agent added. Sulfatase expression levels are measured in both the test sample and the control sample. A comparison is made between sulfatase expression level in the test sample and the control sample. Sulfatase expression can be assessed using conventional assays. For example, when a mammalian cell line is transformed with a construct that results in expression of sulfatase, sulfatase mRNA levels can be detected and measured, as described above, or sulfatase polypeptide levels can be detected and measured, as described above. A suitable period of time for contacting the agent with the cell can be determined empirically, and is generally a time sufficient to allow entry of the agent into the cell and to allow the agent to have a measurable effect on sulfatase mRNA and/or polypeptide levels. Generally, a suitable time is between 10 minutes and 24 hours, more typically about 1-8 hours.

Methods of measuring sulfatase mRNA levels are known in the art, several of which have been described above, and any of these methods can be used in the methods of the present invention to identify an agent which modulates sulfatase mRNA level in a cell, including, but not limited to, a PCR, such as a PCR employing detectably labeled oligonucleotide primers, and any of a variety of hybridization assays. Similarly, sulfatase polypeptide levels can be measured using any standard method, several of which have been described herein, including, but not limited to, an immunoassay such as ELISA, for example an ELISA employing a detectably labeled antibody specific for a sulfatase polypeptide.

Methods of Detecting Agents that Modulate Release of a Subject Sulfatase from a Eukaryotic Cell Methods for identifying agents that modulate release of a sulfatase from a eukaryotic cell generally comprise contacting a cell that normally produces a subject sulfatase with a test agent, and determining the effect, if any, on release of the subject sulfatase.

"Modulation" of release of a subject sulfatase from a eukaryotic cell includes increasing the level and decreasing the level of release of a subject sulfatase from a eukaryotic cell when compared to a control lacking the agent being tested. An increase or decrease of about 1.25-fold, usually at least about 1.5-fold, usually at least about 2-fold, usually at least about 5-fold, usually at least about 10-fold or more, in the level (i.e., an amount) of sulfatase mRNA and/or polypeptide following contacting the cell with a candidate agent being tested, compared to a control to which no agent is added, is an indication that the agent modulates release of a subject sulfatase from a eukaryotic cell.

Cell-based assays generally comprise the steps of contacting the cell with an agent to be tested, forming a test sample, and, after a suitable time, assessing the effect of the agent on release of a subject sulfatase from a eukaryotic cell. A control sample comprises the same cell without the candidate agent added. Release of a subject sulfatase from a eukaryotic cell is measured in both the test sample and the control sample. A comparison is made between release of a subject sulfatase from a eukaryotic cell in the test sample and the control sample. Release of a subject sulfatase from a eukaryotic cell can be assessed using conventional assays to measure sulfatase activity. For example, when a mammalian cell line is transformed with a construct that results in expression of sulfatase, sulfatase enzymatic activity released from the cell can be detected and measured, as described above, or sulfatase polypeptide levels can be detected and measured, as described above. A suitable period of time for contacting the agent with the cell can be determined empirically, and is generally a time sufficient to allow entry of the agent into the cell (if necessary), or any other interaction with the cell, e.g., with cell-surface components) and to allow the agent to have a measurable effect on sulfatase release. Generally, a suitable time is between 10 minutes and 24 hours, more typically about 1-8 hours.

Methods for Identifying an Agent that Modulates Substrate Recognition by a Subject Sulfatase The invention further provides methods of identifying an agent that modulate substrate recognition by a subject sulfatase. The methods generally involve contacting a subject sulfatase with a test agent, and determining the effect, if any, of the agent on substrate recognition. In some embodiments, the assay is a cell-free assay.

Polypeptides that are suitable for use in the instant methods include a full-length subject sulfatase polypeptide; a fragment of a subject sulfatase that includes a G6S-related domain; a fusion polypeptide that includes a G6S-related domain of a subject sulfatase and a heterologous polypeptide fused in-frame; a G6S-related domain of a subject sulfatase.

Agents of interest include those that reduce substrate recognition by at least about 10%, at least about 20%, at least about 30%, at least about 40%, at least about 50%, or more, e.g., by at least about 60%, at least about 70%, at least about 80%, or at least about 90%.

In some embodiments, a subject assay method involves contacting an assay mixture with a test agent, wherein the assay mixture includes a G6S-related domain or G6S-related domain containing polypeptide, as described above; and a substrate for the sulfatase, e.g., a heparan sulfate molecule or a heparin molecule. The effect, if any, of the test agent on the ability of the G6S-related domain or G6S-related domain containing polypeptide to bind to heparan sulfate is determined using a variety of assay formats. For example, a binding assay in which the G6S-related domain or G6S-related domain containing polypeptide is labeled, or in which the heparan sulfate is detectably labeled, is used. The G6S-related domain or G6S-related domain containing polypeptide, in the absence of the test agent, forms a complex with the heparan sulfate. In the presence of a test agent that reduces substrate recognition, the amount of complex formed is reduced. The amount of complex formed is determined using an assay appropriate to the detectable label attached to the detectably labeled member of the complex.

The amount of complex formed is determined using an assay appropriate to the detectable label attached to the detectably labeled member of the complex. Suitable assay formats include immunoprecipitation, Western blotting, enzyme-linked immunosorbent assays (ELISA), and the like.

In some embodiments, the heparan sulfate is immobilized on an insoluble support, and the G6S-related domain or G6S-related domain containing polypeptide is delectably labeled. Binding is assessed by detecting the detectable label bound to the immobilized heparan sulfate. In other embodiments, the G6S-related domain or G6S-related domain containing polypeptide is immobilized on an insoluble support, and the heparan sulfate is detectably labeled. Binding is assessed by detecting the detectable label bound to the immobilized G6S-related domain or G6S-related domain containing polypeptide.

A heparan sulfate or a G6S-related domain or G6S-related domain containing polypeptide can be immobilized directly to an insoluble support, or can be immobilized via a linker or via an antibody that is immobilized on the insoluble support. The detectable label can be a direct detectable label, or an indirect detectable label (e.g., a delectably labeled antibody). Insoluble supports include beads; plastic (e.g., 96-well plates); membranes (e.g., polyvinylpyrollidone, nylon, nitrocellulose, etc.); and the like.

Methods for Identifying an Agent that Reduces Binding of a Coiled-Coil Domain of a Subject Sulfatase with a Second Protein The present invention further provides a method for identifying an agent that reduces coiled-coil domain binding of a subject sulfatase with a second protein. The second protein may be a second sulfatase polypeptide, or another, non-sulfatase protein.

Polypeptides that are suitable for use in the instant methods include a full-length subject sulfatase polypeptide; a fragment of a subject sulfatase that includes a coiled-coil domain; a fusion polypeptide that includes a coiled-coil domain of a subject sulfatase and a heterologous polypeptide fused in-frame; a coiled-coil domain of a subject sulfatase.

Agents of interest include those that reduce binding of a coiled-coil domain of a subject sulfatase to a second protein (a binding partner) by at least about 10%, at least about 20%, at least about 30%, at least about 40%, at least about 50%, or more, e.g., by at least about 60%, at least about 70%, at least about 80%, or at least about 90%.

Suitable assays for detecting binding of a coiled-coil domain of a subject sulfatase with a second protein include, but are not limited to, a fluorescence resonance energy transfer (FRET) assay; a bioluminescence resonance energy transfer (BRET) assay; a fluorescence quenching assay; a fluorescence anisotropy assay; an immunological assay; and an assay involving binding of a detectably labeled protein to an immobilized protein.

In some embodiments; a subject assay method involves contacting an assay mixture with a test agent, wherein the assay mixture includes a coiled-coil domain or coiled-coil domain containing polypeptide, as described above; and a binding partner for the sulfatase, e.g., a second protein that binds the coiled-coil domain. The effect, if any, of the test agent on the ability of the coiled-coil domain or coiled-coil domain containing polypeptide to bind to the second protein is determined using a variety of assay formats. For example, a binding assay in which the coiled-coil domain or coiled-coil domain containing polypeptide is labeled, or in which the second protein is detectably labeled, is used. The coiled-coil domain or coiled-coil domain containing polypeptide, in the absence of the test agent, forms a complex with the binding partner e.g., the second protein). In the presence of a test agent that reduces substrate recognition, the amount of complex formed is reduced. The amount of complex formed is determined using an assay appropriate to the detectable label attached to the detectably labeled member of the complex. Suitable assay formats include immunoprecipitation, Western blotting, enzyme-linked immunosorbent assays ELISA), and the like.

In some embodiments, the binding partner is immobilized on an insoluble support, and the coiled-coil domain or coiled-coil domain-containing polypeptide is detectably labeled. Binding is assessed by detecting the detectable label bound to the immobilized binding partner. In other embodiments, the coiled-coil domain or coiled-coil domain-containing polypeptide is immobilized on an insoluble support, and the binding partner is detectably labeled. Binding is assessed by detecting the detectable label bound to the immobilized coiled-coil domain or coiled-coil domain-containing polypeptide.

A binding partner or a coiled-coil protein can be immobilized directly to an insoluble support, or can be immobilized via a linker or via an antibody that is immobilized on the insoluble support. The detectable label can be a direct detectable label, or an indirect detectable label (e.g., a detectably labeled antibody). Insoluble supports include beads; plastic (e.g., 96-well plates); membranes (e.g., polyvinylpyrollidone, nylon, nitrocellulose, etc.); and the like.

FRET involves the transfer of energy from a donor fluorophore in an excited state to a nearby acceptor fluorophore. For this transfer to take place, the donor and acceptor molecules must in close proximity (e.g., less than 10 nanometers apart, usually between 10 and 100 Å apart), and the emission spectra of the donor fluorophore must overlap the excitation spectra of the acceptor fluorophore. In these embodiments, a fluorescently labeled coiled-coil domain or coiled-coil domain-containing protein serves as a donor and/or acceptor in combination with a second fluorescent protein or dye, e.g., a fluorescent protein as described in Matz et al., *Nature Biotechnology* (October 1999) 17:969-973; a green fluorescent protein (GFP), including a "humanized" GFP; a GFP from *Aequoria victoria* or fluorescent mutant thereof, e.g., as described in U.S. Pat. Nos. 6,066,476; 6,020,192; 5,985,577; 5,976,796; 5,968,750; 5,968,738; 5,958,713; 5,919,445; 5,874,304, the disclosures of which are herein incorporated by reference; a GFP from another species such as *Renilla reniformis*, *Renilla mulleri*, or *Ptilosarcus guernyi*, as described in, e.g., WO 99/49019 and Peelle et al. (2001) *J Protein Chem.* 20:507-519; "humanized" recombinant GFP (hrGFP) (Stratagene); other fluorescent dyes, e.g., coumarin and its derivatives, e.g. 7-amino-4-methylcoumarin, aminocoumarin, bodipy dyes, such as Bodipy FL, cascade blue, fluorescein and its derivatives, e.g. fluorescein isothiocyanate, Oregon green, rhodamine dyes, e.g. texas red, tetramethylrhodamine, eosins and erythrosins, cyanine dyes, e.g. Cy3 and Cy5, macrocyclic chelates of lanthanide ions, e.g. quantum dye, etc., chemilumescent dyes, e.g., luciferases.

BRET is a protein-protein interaction assay based on energy transfer from a bioluminescent donor to a fluorescent acceptor protein. The BRET signal is measured by the amount of light emitted by the acceptor to the amount of light emitted by the donor. The ratio of these two values increases as the two proteins are brought into proximity. The BRET assay has been amply described in the literature. See, e.g., U.S. Pat. Nos. 6,020,192; 5,968,750; and 5,874,304; and Xu et al. (1999) *Proc. Natl. Acad. Sci. USA* 96:151-156. BRET assays may be performed by analyzing transfer between a bioluminescent donor protein and a fluorescent acceptor protein. Interaction between the donor and acceptor proteins can be monitored by a change in the ratio of light emitted by the bioluminescent and fluorescent proteins. In this application, the coiled-coil domain or coiled-coil domain-containing protein serves as donor and/or acceptor protein.

Where the second protein is at least a second sulfatase protein, the effect of the test agent sulfatase. As used herein, the term "multimerization" refers to formation of dimers, trimers, tetramers, and higher multimers of a subject sulfatase. Whether a subject sulfatase forms a complex with one or more additional subject sulfatase molecules can be determined using any known assay, including assays as described above for interacting proteins. Formation of multimers can also be detected using non-denaturing gel electrophoresis, where multimerized subject sulfatase migrates more slowly than monomeric subject sulfatase. Formation of multimers can also be detected using fluorescence quenching techniques.

Formation of multimers can also be detected by analytical ultracentrifugation, for example through glycerol or sucrose gradients, and subsequent visualization of subject sulfatase in gradient fractions by Western blotting or staining of SDS-polyacrylamide gels. Multimers are expected to sediment at defined positions in such gradients. Formation of multimers can also be detected using analytical gel filtration, e.g. in HPLC or FPLC systems, e.g. on columns such as Superdex 200 (Pharmacia Amershar Inc.). Multimers run at defined positions on these columns, and fractions can be analyzed as above. The columns allow one to relate the number and position of peaks directly to the multimerization status of the protein.

Agents

The invention further provides agents, including agents identified using a screening assay of the invention, and compositions comprising the agents, including pharmaceutical compositions. As used herein, the term "agent" refers to a substance that modulates a level of enzymatically active subject sulfatase. In some embodiments, an agent is one identified by a screening assay of the invention. "Modulating a level of enzymatically active subject sulfatase" includes increasing or decreasing enzymatic activity of a subject sulfatase; increasing or decreasing substrate recognition by a subject sulfatase; increasing or decreasing binding of a coiled-coil domain of a subject sulfatase to a second protein; reducing furin-mediated processing of a subject sulfatase; increasing or decreasing a level of enzymatically active sulfatase protein; and increasing or decreasing a level of mRNA encoding enzymatically active subject sulfatase. In some embodiments, an agent is a subject sulfatase, where the subject sulfatase itself is administered to an individual. In some embodiments, an agent is an antibody specific for a subject sulfatase.

The subject compositions can be formulated using well-known reagents and methods. In some embodiments, compositions are provided in formulation with a pharmaceutically acceptable excipient(s). A wide variety of pharmaceutically acceptable excipients are known in the art and need not be discussed in detail herein. Pharmaceutically acceptable excipients have been amply described in a variety of publications, including, for example, A. Gennaro (2000) "Remington: The Science and Practice of Pharmacy," 20th edition, Lippincott, Williams, & Wilkins; Pharmaceutical Dosage Forms and Drug Delivery Systems (1999) H. C. Ansel et al., eds., $7^{th}$ ed., Lippincott, Williams, & Wilkins; and Handbook of Pharmaceutical Excipients (2000) A. H. Kibbe et al., eds., $3^{rd}$ ed. Amer. Pharmaceutical Assoc.

The pharmaceutically acceptable excipients, such as vehicles, adjuvants, carriers or diluents, are readily available to the public. Moreover, pharmaceutically acceptable auxiliary substances, such as pH adjusting and buffering agents, tonicity adjusting agents, stabilizers, wetting agents and the like, are readily available to the public.

Small Molecule Agents

In many embodiments, an active agent is a small molecule, e.g., a small organic or inorganic compound having a molecular weight of more than 50 and less than about 2,500 daltons. Agents may comprise functional groups necessary for structural interaction with proteins, particularly hydrogen bonding, and may include at least an amine, carbonyl, hydroxyl or carboxyl group, and may contain at least two of the functional chemical groups. The agents may comprise cyclical carbon or heterocyclic structures and/or aromatic or polyaromatic structures substituted with one or more of the above functional groups. Agents are also found among biomolecules including peptides, saccharides, fatty acids, steroids, purines, pyrimidines, derivatives, structural analogs or combinations thereof.

Peptide Agents

In some embodiments, an active agent is a peptide. Suitable peptides include peptides of from about 3 amino acids to about 50, from about 5 to about 30, or from about 10 to about 25 amino acids in length. In some embodiments, a peptide exhibits one or more of the following activities: inhibits binding of a coiled-coil domain of a subject sulfatase to an interacting protein; inhibits enzymatic activity of a subject sulfatase molecule; inhibits substrate recognition, mediated by the G6S-related domain of a subject sulfatase; inhibits furin-mediated proteolytic processing of a subject sulfatase. In some embodiments, a peptide has a sequence of from about 3 amino acids to about 50, from about 5 to about 30, or from about 10 to about 25 amino acids of a naturally-occurring subject sulfatase protein.

Peptides can include naturally-occurring and non-naturally occurring amino acids. Peptides may comprise D-amino acids, a combination of D- and L-amino acids, and various "designer" amino acids (e.g., β-methyl amino acids, Cα-methyl amino acids, and Nα-methyl amino acids, etc.) to convey special properties to peptides. Additionally, peptide may be a cyclic peptide. Peptides may include non-classical amino acids in order to introduce particular conformational motifs. Any known non-classical amino acid can be used. Non-classical amino acids include, but are not limited to, 1,2,3,4-tetrahydroisoquinoline-3-carboxylate; (2S,3S)-methylphenylalanine, (2S,3R)-methyl-phenylalanine, (2R,3S)-methyl-phenylalanine and (2R,3R)-methyl-phenylalanine; 2-aminotetrahydronaphthalene-2-carboxylic acid; hydroxy-1,2,3,4-tetrahydroisoquinoline-3-carboxylate; β-carboline (D and L); HIC (histidine isoquinoline carboxylic acid); and HIC (histidine cyclic urea). Amino acid analogs and peptidomimetics may be incorporated into a peptide to induce or favor specific secondary structures, including, but not limited to, LL-Acp (LL-3-amino-2-propenidone-6-carboxylic acid) a β-turn inducing dipeptide analog; β-sheet inducing analogs; 1-turn inducing analogs; α-helix inducing analogs; γ-turn inducing analogs; Gly-Ala turn analog; amide bond isostere; tretrazol; and the like.

A peptide may be a depsipeptide, which may be a linear or a cyclic depsipeptide. Kuisle et al. (1999) *Tet. Letters* 40:1203-1206. "Depsipeptides" are compounds containing a sequence of at least two alpha-amino acids and at least one alpha-hydroxy carboxylic acid, which are bound through at least one normal peptide link and ester links, derived from the hydroxy carboxylic acids, where "linear depsipeptides" may comprise rings formed through S—S bridges, or through an hydroxy or a mercapto group of an hydroxy-, or mercapto-amino acid and the carboxyl group of another amino- or hydroxy-acid but do not comprise rings formed only through peptide or ester links derived from hydroxy carboxylic acids. "Cyclic depsipeptides" are peptides containing at least one ring formed only through peptide or ester links, derived from hydroxy carboxylic acids.

Peptides may be cyclic or bicyclic. For example, the C-terminal carboxyl group or a C-terminal ester can be induced to cyclize by internal displacement of the —OH or the ester (—OR) of the carboxyl group or ester respectively with the N-terminal amino group to form a cyclic peptide. For example, after synthesis and cleavage to give the peptide acid, the free acid is converted to an activated ester by an appropriate carboxyl group activator such as dicyclohexylcarbodiimide (DCC) in solution, for example, in methylene chloride ($CH_2Cl_2$), dimethyl formamide (DMF) mixtures. The cyclic peptide is then formed by internal displacement of the activated ester with the N-terminal amine. Internal cyclization as opposed to polymerization can be enhanced by use of very dilute solutions. Methods for making cyclic peptides are well known in the art The term "bicyclic" refers to a peptide in which there exists two ring closures. The ring closures are formed by covalent linkages between amino acids in the peptide. A covalent linkage between two nonadjacent amino acids constitutes a ring closure, as does a second covalent linkage between a pair of adjacent amino acids which are already linked by a covalent peptide linkage. The covalent linkages forming the ring closures may be amide linkages, i.e., the linkage formed between a free amino on one amino acid and a free carboxyl of a second amino acid, or linkages formed between the side chains or "R" groups of amino acids in the peptides. Thus, bicyclic peptides may be "true" bicyclic peptides, i.e., peptides cyclized by the formation of a peptide bond between the N-terminus and the C-terminus of the peptide, or they may be "depsi-bicyclic" peptides, i.e., peptides in which the terminal amino acids are covalently linked through their side chain moieties.

A desamino or descarboxy residue can be incorporated at the termini of the peptide, so that there is no terminal amino or carboxyl group, to decrease susceptibility to proteases or to restrict the conformation of the peptide. C-terminal functional groups include amide, amide lower alkyl, amide di(lower alkyl), lower alkoxy, hydroxy, and carboxy, and the lower ester derivatives thereof and the pharmaceutically acceptable salts thereof.

In addition to the foregoing N-terminal and C-terminal modifications, a peptide or peptidomimetic can be modified with or covalently coupled to one or more of a variety of hydrophilic polymers to increase solubility and circulation half-life of the peptide. Suitable nonproteinaceous hydrophilic polymers for coupling to a peptide include, but are not limited to, polyalkylethers as exemplified by polyethylene glycol and polypropylene glycol, polylactic acid, polyglycolic acid, polyoxyalkenes, polyvinylalcohol, polyvinylpyrrolidone, cellulose and cellulose derivatives, dextran and dextran derivatives, etc. Generally, such hydrophilic polymers have an average molecular weight ranging from about 500 to about 100,000 daltons, from about 2,000 to about 40,000 daltons, or from about 5,000 to about 20,000 daltons. The peptide can be derivatized with or coupled to such polymers using any of the methods set forth in Zallipsky, S., Bioconjugate Chem., 6:150-165 (1995); Monfardini, C, et al., Bioconjugate Chem., 6:62-69 (1995); U.S. Pat. Nos. 4,640,835; 4,496,689; 4,301,144; 4,670,417; 4,791,192; 4,179,337 or WO 95/34326.

Another suitable agent for reducing an activity of a subject sulfatase is a peptide aptamer. Peptide aptamers are peptides or small polypeptides that act as dominant inhibitors of protein function. Peptide aptamers specifically bind to target proteins, blocking their function ability. Kolonin and Finley, PNAS (1998) 95:14266-14271. Due to the highly selective nature of peptide aptamers, they may be used not only to target a specific protein, but also to target specific functions of a given protein (e.g. a signaling function). Further, peptide aptamers may be expressed in a controlled fashion by use of promoters which regulate expression in a temporal, spatial or inducible manner. Peptide aptamers act dominantly; therefore, they can be used to analyze proteins for which loss-of-function mutants are not available.

Peptide aptamers that bind with high affinity and specificity to a target protein may be isolated by a variety of techniques known in the art. Peptide aptamers can be isolated from random peptide libraries by yeast two-hybrid screens (Xu et al., PNAS (1997) 94:12473-12478). They can also be isolated from phage libraries (Hoogenboom et al., Immunotechnology (1998) 4:1-20) or chemically generated peptides/libraries.

Intrabodies

Intracellularly expressed antibodies, or intrabodies, are single-chain antibody molecules designed to specifically bind and inactivate target molecules inside cells. Intrabodies have been used in cell assays and in whole organisms. Chen et al., Hum. Gen. Ther. (1994) 5:595-601; Hassanzadeh et al., Febs Lett. (1998) 16(1,2):75-80 and 81-86. Inducible expression vectors can be constructed with intrabodies that react specifically with subject sulfatase protein. These vectors can be introduced into model organisms and studied in the same manner as described above for aptamers.

Antibodies

In some embodiments, the active agent is an antibody specific for a subject sulfatase, or a domain or epitope of a subject sulfatase. For example, an active agent includes an antibody that is specific for a coiled-coil domain of a subject sulfatase, which antibody reduces binding of a subject sulfatase to a second protein. As another example, an active agent is an antibody that binds a G6-related domain, or epitope thereof; of a subject sulfatase, which antibody reduces substrate recognition by the subject sulfatase.

In some of the invention, the active agent is an agent that modulates, and generally decreases or down regulates, the expression of the gene encoding a subject sulfatase in the host. Such agents include, but are not limited to, antisense RNA, interfering RNA, ribozymes, and the like, as described below.

The invention further provides methods for reducing a sulfatase activity of a subject sulfatase; methods of reducing substrate recognition by a subject sulfatase; methods of reducing binding of a coiled-coil domain of a subject sulfatase to a second protein (e.g., where the second protein is a sulfatase polypeptide, or a non-sulfatase polypeptide); and methods of reducing furin-mediated proteolytic cleavage of a subject sulfatase. The methods generally involve contacting a subject sulfatase (either in vitro or in vivo) with an appropriate agent, as described herein.

Nucleic Acid and Polypeptide Therapeutic Compositions

The nucleic acid compositions and polypeptide compositions of the subject invention also find use as therapeutic agents in situations where one wishes to enhance sulfatase activity in a host, particularly the activity of the subject polypeptides, or to provide sulfatase activity at a particular anatomical site. The present invention further provides therapeutic sulfatase polypeptides (and compositions comprising the therapeutic sulfatase polypeptides), where the therapeutic sulfatase polypeptide inhibits the activity of an endogenous sulfatase, e.g., by inhibiting binding of an endogenous sulfatase to a cell surface, by inhibiting the ability of an endogenous sulfatase to activate Wnt, etc.). The present invention further provides therapeutic sulfatase polynucleotides (and compositions comprising the therapeutic sulfatase polynucleotides), where the therapeutic sulfatase polynucleotides reduce the level of sulfatase activity, intracellularly and/or extracellularly.

In some embodiments, a subject sulfatase polypeptide (e.g., a therapeutic sulfatase polypeptide) or a subject sulfatase polynucleotide (e.g., a therapeutic sulfatase polynucleotide) is provided in a pharmaceutical composition with a pharmaceutically acceptable excipient. Pharmaceutically acceptable excipients have been amply described in a variety of publications, including, for example, A. Gennaro (2000) "Remington: The Science and Practice of Pharmacy," 20th edition, Lippincott, Williams, & Wilkins; Pharmaceutical Dosage Forms and Drug Delivery Systems (1999) H. C. Ansel et al., eds., 7 ed., Lippincott, Williams, & Wilkins; and Handbook of Pharmaceutical Excipients (2000) A. H. Kibbe et al., eds., $3^{rd}$ ed. Amer. Pharmaceutical Assoc.

The pharmaceutically acceptable excipients, such as vehicles, adjuvants, carriers or diluents, are readily available to the public. Moreover, pharmaceutically acceptable auxiliary substances, such as pH adjusting and buffering agents, tonicity adjusting agents, stabilizers, wetting agents and the like, are readily available to the public.

The subject genes, gene fragments, or the encoded proteins or protein fragments are useful in therapy to treat disorders associated with an activity of a subject sulfatase. Expression vectors may be used to introduce the gene into a cell. Such vectors generally have convenient restriction sites located near the promoter sequence to provide for the insertion of nucleic acid sequences. Transcription cassettes may be prepared comprising a transcription initiation region, the target gene or fragment thereof, and a transcriptional termination region. The transcription cassettes may be introduced into a variety of vectors, e.g. plasmid; retrovirus, e.g. lentivirus; adenovirus; and the like, where the vectors are able to transiently or stably be maintained in the cells, usually for a period of at least about one day, more usually for a period of at least about several days to several weeks.

The gene or protein may be introduced into tissues or host cells by any number of routes, including viral infection, microinjection, or fusion of vesicles. Jet injection may also be used for intramuscular administration, as described by Furth et al (1992), *Anal Biochem* 205:365-368. The DNA may be coated onto gold microparticles, and delivered intradermally by a particle bombardment device, or "gene gun" as described in the literature (see, for example, Tang et al. (1992), *Nature* 356:152-154), where gold microprojectiles are coated with the DNA, then bombarded into skin cells.

In yet other embodiments of the invention, the active agent is an agent that modulates, and generally decreases or down regulates, the expression of the gene encoding the target protein in the host. For example, antisense molecules can be used to down-regulate expression of the subject genes in cells. The anti-sense reagent may be antisense oligonucleotides (ODN), particularly synthetic ODN having chemical modifications from native nucleic acids, or nucleic acid constructs that express such anti-sense molecules as RNA. The antisense sequence is complementary to the mRNA of the targeted gene, and inhibits expression of the targeted gene products. Antisense molecules inhibit gene expression through various mechanisms, e.g. by reducing the amount of mRNA available for translation, through activation of RNAse H, or steric hindrance. One or a combination of antisense molecules may be administered, where a combination may comprise multiple different sequences.

Antisense molecules may be produced by expression of all or a part of the target gene sequence in an appropriate vector, where the transcriptional initiation is oriented such that an antisense strand is produced as an RNA molecule. Alternatively, the antisense molecule is a synthetic oligonucleotide. Antisense oligonucleotides will generally be at least about 7, usually at least about 12, more usually at least about 20 nucleotides in length, and not more than about 500, usually not more than about 50, more usually not more than about 35 nucleotides in length, where the length is governed by efficiency of inhibition, specificity, including absence of cross-reactivity, and the like. It has been found that short oligonucleotides, of from 7 to 8 bases in length, can be strong and selective inhibitors of gene expression (see Wagner et at (1996), *Nature Biotechnol* 14:840-844).

A specific region or regions of the endogenous sense strand mRNA sequence is chosen to be complemented by the antisense sequence. Selection of a specific sequence for the oligonucleotide may use an empirical method, where several candidate sequences are assayed for inhibition of expression of the target gene in an in vitro or animal model. A combination of sequences may also be used, where several regions of the mRNA sequence are selected for antisense complementation.

Antisense oligonucleotides may be chemically synthesized by methods known in the art (see Wagner et at (1993), supra, and Milligan et al., supra.) Preferred oligonucleotides are chemically modified from the native phosphodiester structure, in order to increase their intracellular stability and binding affinity. A number of such modifications have been described in the literature, which modifications alter the chemistry of the backbone, sugars or heterocyclic bases.

Among useful changes in the backbone chemistry are phosphorothioates; phosphorodithioates, where both of the non-bridging oxygens are substituted with sulfur; phosphoroamidites; alkyl phosphotriesters and boranophosphates.

Achiral phosphate derivatives include 3'-O'-5'-S-phosphorothioate, 3'-S-5'-O-phosphorotioate, 3'-CH2-5'-O-phosphonate and 3'-NE-5'-O-phosphoroamidate. Peptide nucleic acids replace the entire ribose phosphodiester backbone with a peptide linkage. Sugar modifications are also used to enhance stability and affinity. The β-anomer of deoxyribose may be used, where the base is inverted with respect to the natural α-anomer. The 2'-OH of the ribose sugar may be altered to form 2'-O-methyl or 2'-O-allyl sugars, which provides resistance to degradation without comprising affinity. Modification of the heterocyclic bases must maintain proper base pairing. Some useful substitutions include deoxyuridine for deoxythymidine; 5-methyl-2'-deoxycytidine and 5-bromo-2'-deoxycytidine for deoxycytidine. 5-propynyl-2'-deoxyuridine and 5-propynyl-2'-deoxycytidine have been shown to increase affinity and biological activity when substituted for deoxythymidine and deoxycytidine, respectively.

As an alternative to anti-sense inhibitors, catalytic nucleic acid compounds, e.g. ribozymes, anti-sense conjugates, etc. may be used to inhibit gene expression. Ribozymes may be synthesized in vitro and administered to the patient, or may be encoded on an expression vector, from which the ribozyme is synthesized in the targeted cell (for example, see International patent application WO 9523225, and Beigelman et al. (1995), *Nucl. Acids Res.* 23:4434-42). Examples of oligonucleotides with catalytic activity are described in WO 9506764. Conjugates of anti-sense ODN with a metal complex, e.g. terpyridylCu(II), capable of mediating mRNA hydrolysis are described in Bashkin et al (1995), *Appl. Biochem. Biotechnol.* 54:43-56.

In some embodiments, the active agent is an interfering RNA (RNAi). RNAi includes double-stranded RNA interference (dsRNAi). Use of RNAi to reduce a level of a particular mRNA and/or protein is based on the interfering properties of double-stranded RNA derived from the coding regions of gene. In one example of this method, complementary sense and antisense RNAs derived from a substantial portion of the subject sulfatase gene are synthesized in vitro. The resulting sense and antisense RNAs are annealed in an injection buffer, and the double-stranded RNA injected or otherwise introduced into the subject (such as in their food or by soaking in the buffer containing the RNA). See, e.g., WO99/32619. In another embodiment, dsRNA derived from a subject sulfatase gene is generated in vivo by simultaneous expression of both sense and antisense RNA from appropriately positioned promoters operably linked to a subject sulfatase coding sequences in both sense and antisense orientations.

siRNA Nucleic Acids

One approach well known in the art for inhibiting gene expression is short interfering RNA (siRNA) mediated gene silencing, where the level of expression product of a target gene is reduced by specific double stranded siRNA nucleotide sequences that are complementary to at least a 19-25 nucleotide long segment (e.g., a 20-21 nucleotide sequence) of the target gene transcript, including the 5' untranslated JUT) region, the ORF, or the 3' UT region. In some embodiments, short interfering RNAs are about 19-25 nt in length. See, e.g., PCT applications WOO/44895, WO99/32619, WO01/75164, WO01/92513, WO01/29058, WO01/89304, WO02/16620, and WO02/29858; and U.S. Patent Publication No. 20040023390 for descriptions of siRNA technology. The siRNA can be encoded by a nucleic acid sequence, and the nucleic acid sequence can also include a promoter. The nucleic acid sequence can also include a polyadenylation signal. In some embodiments, the polyadenylation signal is a synthetic minimal polyadenylation signal.

Suitable siRNA-encoding nucleic acids include nucleic acids comprising a nucleotide sequence encoding an siRNA that reduces the level of HSulf-1 polypeptide or HSulf-2 polypeptide produced by a cell by at least about 5%, at least about 10%, at least about 20%, at least about 25%, at least about 30%, at least about 40%, at least about 50%, at least about 60%, at least about 70%, at least about 80%, or more, compared to the level of HSulf-1 or HSulf-2 produced by the cell in the absence of the siRNA-encoding nucleic acid.

The present invention provides nucleic acids that comprise a nucleotide sequence that encodes an siRNA as described above, which nucleotide sequence is operably linked to a promoter that is functional in a eukaryotic cell, e.g., a cancerous cell, such as an autocrine Wnt signaling cancer cell. The present invention further provides vectors, including expression vectors, which include a subject siRNA-encoding nucleic acid; and host cells that harbor a subject siRNA-encoding nucleic acid or a subject siRNA-encoding expression vector.

A subject siRNA-encoding nucleic acid comprises, in order from 5' to 3' and in operable linkage, a promoter functional in a eukaryotic cell (e.g., an autocrine Wnt signaling cancer cell), and a nucleotide sequence that encodes an siRNA that, when produced in the eukaryotic cell, reduces the level HSulf protein (e.g., HSulf-1 protein and/or HSulf-2 protein) in the cell.

In some embodiments, the promoter is an inducible promoter, e.g., the target cell-specific promoter includes one or more regulatory elements that confer inducible transcriptional control on an operably linked coding region. Inducible promoters and control elements are known in the art and include, but are not limited to, an androgen-inducible promoter; a hormone-inducible promoter; a heavy metal inducible promoter; and the like.

In some embodiments, a subject nucleic acid comprises an siRNA coding sequence operably linked to a promoter. A subject nucleic acid comprises a nucleic acid that encodes an siRNA (also referred to herein as "an siRNA agent"). Suitable siRNA agents include siRNA agents that modulate expression of a target sulfatase-encoding gene (e.g., HSulf-1, HSulf-2, etc.) by an RNA interference mechanism. A "small interfering" or "short interfering RNA" or siRNA is a RNA duplex of nucleotides that is targeted to a gene interest (a "target gene" or a "target coding sequence"). An "RNA duplex" refers to the structure formed by the complementary pairing between two regions of a RNA molecule. siRNA is "targeted" to a gene in that the nucleotide sequence of the duplex portion of the siRNA is complementary to a nucleotide sequence of the targeted sulfatase gene (e.g., HSulf-1, HSulf-2, etc.). In some embodiments, the length of the duplex of siRNAs is less than 30 nucleotides. In some embodiments, the duplex can be 29 nucleotides (nt), 28 nt, 27 nt, 26 nt, 25 nt, 24 nt, 23 nt, 22 nt, 21 nt, 20 nt, 19 nt, 18 nt, 17 nt, 16 nt, 15 nt, 14 nt, 13 nt 12 nt, 11 nt, or 10 nucleotides in length. In some embodiments, the length of the duplex is 19-25 nucleotides in length. The RNA duplex portion of the siRNA can be part of a short hairpin structure (shRNA). In addition to the duplex portion, the hairpin structure may contain a loop portion positioned between the two sequences that form the duplex. The loop can vary in length. In some embodiments the loop is 5 nt, 6 nt, 7 nt, 8 nt, 9 nt, 10 nt, 11 nt, 12 nt, or 13 nucleotides in length. The hairpin structure can also contain 3' or 5' overhang portions. In some embodiments, the overhang is a 3' or a 5' overhang 0 nt, 1 nt, 2 nt, 3 nt, 4 nt, or 5 nucleotides in length.

In some embodiments, a subject nucleic acid agent comprises a nucleotide sequence encoding an siRNA that, when produced in a eukaryotic cell, reduces the level of HSulf-1 and/or HSulf-2 mRNA and/or protein in the cell. In some embodiments, a subject siRNA-encoding nucleic acid comprises the nucleotide sequence 5'-GCTGCATAAGTGC-3' (SEQ ID NO:27). In some embodiments, a subject siRNA-encoding nucleic acid comprises the nucleotide sequence 5'-GCTGCATAAGTGC(X)$_n$GCACTTATGCAGC-3' (SEQ ID NO:28; where X is any nucleotide and n is an integer from 1 to 10). In some embodiments, a subject siRNA-encoding nucleic acid comprises the nucleotide sequence 5'-GCTGCATAAGTGC TTTTTGCGCACTTATGCAGC-3' (SEQ ID NO:29).

In other embodiments, a subject siRNA-encoding nucleic acid comprises the nucleotide sequence 5'-AACAGGTTTC-GAACAAACAAG-3' (SEQ ID NO:30). In other embodiments, a subject siRNA-encoding nucleic acid comprises the nucleotide sequence 5'-AACAGGTTTCGAACAAACAAG (X)$_n$CTTGTTTGTTCGAAACCTGTT-3' (SEQ ID NO:31; where X is any nucleotide and n is an integer from 1 to 10). In other embodiments, a subject siRNA-encoding nucleic acid comprises the nucleotide sequence 5'-AACAGGTTTCGAA-CAAACAAGTTTTTGCCTTGTTTGTTC-GAAACCTGTT-3' (SEQ ID NO:32). These nucleic acids will be of particular interest in reducing the level of HSulf-1 polypeptide produced by a cell.

In other embodiments, a subject siRNA-encoding nucleic acid comprises the nucleotide sequence 5'-AAGCTTC-GAATTCACAAGTGT-3' (SEQ ID NO:33). In other embodiments, a subject siRNA-encoding nucleic acid comprises the nucleotide sequence 5'-AAGCTTCGAATTCACAAGTGT (X)$_n$ACACTTGTGAATTCGAAGCTT-3' (SEQ ID NO:34; where X is any nucleotide and n is an integer from 1 to 10). In other embodiments, a subject siRNA-encoding nucleic acid comprises the nucleotide sequence 5'-AAGCTTCGAAT-TCACAAGTGTTTTTTGCACACTTGT-GAATTCGAAGCTT-3' (SEQ ID NO:35). These nucleic acids will be of particular interest in reducing the level of HSulf-1 polypeptide produced by a cell.

In other embodiments, a subject siRNA-encoding nucleic acid comprises the nucleotide sequence 5'-AAAGAGC-CATCTCACCCATT-3' (SEQ ID NO:36). In other embodiments, a subject siRNA-encoding nucleic acid comprises the nucleotide sequence 5'-AAAGAGCCATCTCACCCATT (X)$_n$ AATGGGTGAGATGGCTCTTT-3' (SEQ ID NO:37; where X is any nucleotide and n is an integer from 1 to 10). In other embodiments, a subject siRNA-encoding nucleic acid comprises the nucleotide sequence 5'-AAAGAGCCATCT-CACCCATTTTTTTGCAATGGGTGAGATGGCTCTTT-3' (SEQ ID NO:38). These nucleic acids will be of particular interest in reducing the level of HSulf-1 polypeptide produced by a cell.

In other embodiments, a subject siRNA-encoding nucleic acid comprises the nucleotide sequence 5'-AAGCT-GAAGCTGCATAAGTGC-3' (SEQ ID NO:39). In other embodiments, a subject siRNA-encoding nucleic acid comprises the nucleotide sequence 5'-AAGCTGAAGCTGCAT-AAGTGC(X)$_n$GCACTTATGCAGCTTCAGCTT-3' (SEQ ID NO:40; where X is any nucleotide and n is an integer from 1 to 10). In other embodiments, a subject siRNA-encoding nucleic acid comprises the nucleotide sequence 5'-AAGCT-GAAGCTGCATAAGTGCTTTTTGCGCACT-TATGCAGCTTCAGCTT-3' (SEQ ID NO:41). These nucleic acids will be of particular interest in reducing the level of HSulf-2 polypeptide produced by a cell.

In other embodiments, a subject siRNA-encoding nucleic acid comprises the nucleotide sequence 5'-AAATGAA-GAGACCTTCTTCCA-3' (SEQ ID NO:42). In other embodiments, a subject siRNA-encoding nucleic acid comprises the nucleotide sequence 5'-AAATGAAGAGACCT-TCTTCCA(X)$_n$TGGAAGAAGGTCTCTTCATTT-3' (SEQ ID NO:43; where X is any nucleotide and n is an integer from 1 to 10). In other embodiments, a subject siRNA-encoding nucleic acid comprises the nucleotide sequence 5'-AAAT-GAAGAGACCTTCTTCCATTTTTGCTG-GAAGAAGGTCTCTTCATTT-3' (SEQ ID NO:44). These nucleic acids will be of particular interest in reducing the level of HSulf-2 polypeptide produced by a cell.

Preparing a Subject Nucleic Acid

Preparation of a subject nucleic acid accomplished utilizing any of the methods known to one skilled in the art. Changes in nucleotide sequence of any given nucleic acid is accomplished by any of various standard methods, including site-specific mutagenesis, polymerase chain reaction (PCR) amplification using degenerate oligonucleotides, exposure of cells containing the nucleic acid to mutagenic agents or radiation, chemical synthesis of a desired oligonucleotide (e.g., in conjunction with ligation and/or cloning to generate large nucleic acids) and other well-known techniques. See; e.g., Berger and Kimmel, Guide to Molecular Cloning Techniques, Methods in Enzymology, Volume 152 Academic Press, Inc., San Diego, Calif. (Berger); Sambrook et al., Molecular Cloning—A Laboratory Manual (2nd ed.) Vol. 1-3, Cold Spring Harbor Laboratory, Cold Spring Harbor Press, N.Y., (Sambrook) (1989); and Current Protocols in Molecular Biology, F. M. Ausubel et al., eds., Current Protocols, a joint venture between Greene Publishing Associates, Inc. and John Wiley & Sons, Inc., (1994 Supplement) (Ausubel); Pirrung et al., U.S. Pat. No. 5,143,854; and Fodor et al., Science, 251:767-77 (1991). Using these techniques, it is possible to insert or delete, at will, a polynucleotide of any length into a subject nucleic acid.

A subject nucleic acid, or a fragment of a subject nucleic acid, will in some embodiments be prepared using chemical synthesis of linear oligonucleotides which may be carried out utilizing techniques well known in the art. The synthesis method selected will depend on various factors including the length of the desired nucleic acid and such choice is within the skill of the ordinary artisan. Oligonucleotides are typically synthesized chemically according to the solid phase phosphoramidite triester method described by Beaucage and Caruthers, Tetrahedron Letts., 22(20):1859-1862 (1981), e.g., using an automated synthesizer, as described in Needham-VanDevanter et al., Nucleic Acids Res., 12:6159-6168 (1984). Oligonucleotides can also be custom made and ordered from a variety of commercial sources known to persons of skill in the aft.

Synthetic linear oligonucleotides maybe purified by polyacrylamide gel electrophoresis, or by any of a number of chromatographic methods, including gel chromatography and high pressure liquid chromatography. The sequence of the synthetic oligonucleotides can be verified using the chemical degradation method of Maxam and Gilbert in Grossman and Moldave (eds.) Academic Press, New York, Methods in Enzymology, 65:499-560 (1980). If modified bases are incorporated into the oligonucleotide, and particularly if modified phosphodiester linkages are used, then the synthetic procedures are altered as needed according to known procedures. In this regard, Uhlmann, et al., Chemical Reviews, 90:543-584 (1990) provide references and outline procedures for making oligonucleotides with modified bases and modified phosphodiester linkages. Sequences of short oligonucleotides can also be analyzed by laser desorption mass spectroscopy or by fast atom bombardment (McNeal, et al., J. Am. Chem. Soc., 104:976 (1982); Viari, et al., Biomed. Enciron. Mass Spectrom., 14:83 (1987); Grotjahn et al., Nuc. Acid Res., 10:4671 (1982)).

Linear oligonucleotides may also be prepared by polymerase chain reaction (PCR) techniques as described, for example, by Saiki et al., Science, 239:487 (1988). In vitro amplification techniques suitable for amplifying nucleotide sequences are also well known in the art. Examples of such techniques including the polymerase chain reaction (PCR), the ligase chain reaction (LCR), Qβ-replicase amplification and other RNA polymerase mediated techniques (e.g., NASBA) are found in Berger, Sambrook, and Ausubel, as well as Mullis et al., (1987) U.S. Pat. No. 4,683,202; PCR Protocols A Guide to Methods and Applications (Innis et al., eds) Academic Press Inc., San Diego, Calif. (1990) (Innis); Arnheim & Levinson (Oct. 1, 1990) C&EN 36-47; The Journal Of NIH Research, 3:81-94 (1991); (Kwoh et al., (1989) Proc. Natl. Acad. Sci. USA, 86:1173; Guatelli et al., Proc. Natl. Acad. Sci. USA, 87:1874 (1990); Lomell et al., J. Clin. Chem., 35:1826 (1989); Landegren et al., Science, 241:1077-1080 (1988); Van Brunt, Biotechnology, 8:291-294 (1990); Wu and Wallace, Gene, 4:560 (1989); Barringer et al., *Gene,* 89:117 (1990), and Sooknanan and Malek, Biotechnology, 13:563-564 (1995). Improved methods of cloning in vitro amplified nucleic acids are described in Wallace et al., U.S. Pat. No. 5,426,039.

Recombinant Vectors

The above nucleic acid constructs comprising an siRNA coding domain operably linked to a promoter are, in many embodiments, present in a vector. A vector that comprises a subject nucleic acid is referred to herein as a "recombinant vector." The constructs may be present on any convenient type of vector, where representative vectors of interest include, but are not limited to: plasmid vectors, viral vectors, and the like.

Certain types of vectors allow the expression cassettes of the present invention to be amplified. Other types of vectors are necessary for efficient introduction of subject nucleic acid to cells and their stable expression once introduced. Any vector capable of accepting a subject nucleic acid is contemplated as a suitable recombinant vector for the purposes of the invention. The vector may be any circular or linear length of DNA that either integrates into the host genome or is maintained in episomal form. Vectors may require additional manipulation or particular conditions to be efficiently incorporated into a host cell (e.g., many expression plasmids), or can be part of a self-integrating, cell specific system (e.g., a recombinant virus). The vector is in some embodiments functional in a prokaryotic cell, where such vectors function to propagate the recombinant vector. The vector is in some embodiments functional in a eukaryotic cell, where the vector will in many embodiments be an expression vector.

Representative eukaryotic plasmid vectors of interest include, for example: pCMVneo, pShuttle, pDNR and Ad-X (Clontech Laboratories, Inc.); as well as BPV, EBV, vaccinia, SV40, 2-micron circle, pcDNA3.1, pcDNA3.1/GS, pYES2/GS, pMT, p IND, pIND(Sp1), pVgRXR, and the like, or their derivatives. Such plasmids are well known in the art (Botstein et al., Miami Wntr. SyTnp. 19:265-274, 1982; Broach, In: "The Molecular Biology of the Yeast *Saccharomyces*: Life Cycle and Inheritance", Cold Spring Harbor Laboratory, Cold Spring Harbor, N.Y., p. 445-470, 1981; Broach, Cell 28:203-204, 1982; Dilon et al., J. Clin. Hematol. Oncol. 10:39-48, 1980; Maniatis, In: Cell Biology: A Comprehensive Treatise, Vol. 3, Gene Sequence Expression, Academic Press, NY, pp. 563-608, 1980.

Certain vectors, "expression vectors," are capable of directing the expression of genes. Any expression vector comprising an expression cassette of the present invention qualifies as an expression cassette of the present invention. In general, expression vectors of utility in recombinant DNA techniques often are in the form of plasmids. In some embodiments, a subject vector is a viral vector, e.g., replication defective retroviruses, lentiviruses, adenoviruses; adeno-associated viruses (e.g., AAV-1, AAV-2, etc.; baculovirus, CaMV; herpesviruses; vaccinia virus; and the like.

Examples of suitable prokaryotic expression vectors that can be engineered to accept a subject nucleic acid include pTrc (Amann et al., Gene, 69:301-315 (1988)) and pBluescript (Stratagene, San Diego, Calif.). Examples of vectors for expression in yeast *S. cerevisiae* include pYepSec1 (Baldari et al., EMBO J., 6:229-234 (1987)), pMFa (Kujan and Herskowitz, Cell, 30:933-943 (1982)), pJRY88 (Schultz et al., Gene, 54:113-123 (1987)), pYES2 (Invitrogen, Carlsbad, Calif.), and pPicZ (Invitrogen, Carlsbad, Calif.). Baculovirus vectors are often used for expression of dsRNAs in cultured insect cells (e.g., Sf9 cells see, U.S. Pat. No. 4,745,051) and include the pAc series (Smith et al., Mol. Cell. Biol., 3:2156-2165 (1983)), the pVL series (Lucklow and Summers, Virology, 170:31-39 (1989)) and pBlueBac (available from Invitrogen, San Diego).

Infection of cells with a viral vector will in some embodiments be used for introducing expression cassettes of the present invention into cells. The viral vector approach has the advantage that a large proportion of cells receive the expression cassette, which can obviate the need for selection of cells that have been successfully transfected. Exemplary mammalian viral vector systems include retroviral vectors, lentiviral vectors, adenoviral vectors, adeno-associated type 1 ("AAV-1") or adeno-associated type 2 ("AAV-2") vectors, hepatitis delta vectors, live, attenuated delta viruses, and herpes viral vectors.

In some embodiments, a subject recombinant vector is a retroviral vector. Retroviruses are RNA viruses that are useful for stably incorporating genetic information into the host cell genome. When a retrovirus infects cells, their RNA genomes are converted to a dsDNA form (by the viral enzyme reverse transcriptase). The viral DNA is efficiently integrated into the host genome, where it permanently resides, replicating along with host DNA at each cell division. The integrated provirus steadily produces viral RNA from a strong promoter located at the end of the genome (in a sequence called the long terminal repeat or LTR). This viral RNA serves both as mRNA for the production of viral proteins and as genomic RNA for new viruses. Viruses are assembled in the cytoplasm and bud from the cell membrane, usually with little effect on the cell's health. Thus, the retrovirus genome becomes a permanent part of the host cell genome, and any foreign gene placed in a retrovirus ought to be expressed in the cells indefinitely. Retroviruses are therefore attractive vectors because they can permanently express a foreign gene in cells. Most or possibly all regions of the host genome are accessible to retroviral integration (Withers-Ward et al., Genes Dev., 8:1473-1487 (1994)). Moreover, they can infect virtually every type of mammalian cell, making them exceptionally versatile.

Retroviral vector particles are prepared by recombinantly inserting a subject nucleic acid into a retroviral vector and packaging the vector with retroviral proteins by use of a packaging cell line or by co-transfecting non-packaging cell lines with the retroviral vector and additional vectors that express retroviral proteins. The resultant retroviral vector particle is generally incapable of replication in the host cell and is capable of integrating into the host cell genome as a proviral sequence containing the expression cassette containing a nucleic acid encoding an siRNA. As a result, the host cell produces the siRNA encoded by the subject recombinant expression vector.

Packaging cell lines are generally used to prepare the retroviral vector particles. A packaging cell line is a genetically constructed mammalian tissue culture cell line that produces the necessary viral structural proteins required for packaging, but which is incapable of producing infectious virions. Retroviral vectors, on the other hand, lack the structural genes but have the nucleic acid sequences necessary for packaging. To prepare a packaging cell line, an infectious clone of a desired retrovirus, in which the packaging site has been deleted, is constructed. Cells comprising this construct will express all structural proteins but the introduced DNA will be incapable of being packaged. Alternatively, packaging cell lines can be produced by introducing into a cell line one or more expression plasmids encoding the appropriate core and envelope proteins. In these cells, the gag, pol, and env genes can be derived from the same or different retroviruses.

A number of packaging cell lines suitable for the present invention are available in the art. Examples of these cell lines include Crip, GPE86, PA317 and PG13. See, e.g., Miller et al., J. Virol., 65:2220-2224 (1991). Examples of other packaging cell lines are described in Cone and Mulligan, Proceedings of the National Academy of Sciences, U.S.A., 81:6349-6353 (1984) and in Danos and Mulligan, Proceedings of the National Academy of Sciences, U.S.A., 85:6460-6464 (1988); Eglitis et al. Biotechniques, 6:608-614 (1988); Miller et al., Biotechniques, 7:981-990 (1989). Amphotropic or xenotropic envelope proteins, such as those produced by PA317 and GPX packaging cell lines may also be used to package the retroviral vectors.

Defective retroviruses are well characterized for use in gene transfer to mammalian cells (for a review see Miller, A. D., Blood, 76:271 (1990)). A recombinant retrovirus can be constructed having a subject nucleic acid inserted into the retroviral genome. Additionally, portions of the retroviral genome can be removed to render the retrovirus replication defective. The replication defective retrovirus is then packaged into virions that can be used to infect a target cell through the use of a helper virus by standard techniques. Protocols for producing recombinant retroviruses and for infecting cells in vitro or in vivo with such viruses can be found in Current Protocols in Molecular Biology, Ausubel, F. M. et al. (eds.) Greene Publishing Associates, (1989), Sections 9.10-9.14 and other standard laboratory manuals.

Examples of suitable retroviruses include pLJ, pZIP, pWE and pEM which are well known to those skilled in the art. Examples of suitable packaging virus lines include ψCrip, ψCre, ψ2, and ψAm. Retroviruses have been used to introduce a variety of genes into many different cell types, including epithelial cells, endothelial cells, lymphocytes, myoblasts, hepatocytes, bone marrow cells, in vitro and/or in vivo (see for example Eglitis, et al., Science, 230:1395-1398 (1985); Danos and Mulligan, Proc. Natl. Acad. Sci. USA, 85:6460-6464 (1988); Wilson et al., Proc. Natl. Acad. Sci. USA, 85:3014-3018 (1988); Armentano et al., Proc. Natl. Acad. Sci. USA, 87:6141-6145 (1990); Huber et al., Proc. Natl. Acad. Sci. USA, 88:8039-8043 (1991); Ferry et al., Proc. Natl. Acad. Sci. USA, 88:8377-8381 (1991); Chowdhury et al., Science, 254:1802-1805 (1991); van Beusechem et al., Proc. Natl. Acad. Sci. USA, 89:7640-7644 (1992); Kay et al., Human Gene Therapy, 3:641-647 (1992); Dai et al., Proc. Natl. Acad. Sci. USA, 89:10892-10895 (1992); Hwu et al., J. Immunol., 150:4:104-115 (1993); U.S. Pat. No. 4,868,116; U.S. Pat. No. 4,980,286; PCT Application WO 89/07136; PCT Application WO 89/02468; PCT Application WO 89/05345; and PCT Application WO 92/07573; EPA 0 178 220; U.S. Pat. No. 4,405,712; Gilboa, Biotechniques, 4:504-512 (1986); Mann et al., Cell, 33:153-159 (1983); Cone and Mulligan, Proc. Natl. Acad. Sci. USA, 81:6349-6353 (1984); Eglitis et al., Biotechniques 6:608-614 (1988); Miller et al., Biotechniques, 7:981-990 (1989); Miller, Nature (1992), supra; Mulligan, Science, 260:926-932 (1993); and Gould et al., and International Patent Application No. WO 92/07943 entitled "Retroviral Vectors Useful in Gene Therapy.").

The genome of an adenovirus can be manipulated such that it includes a subject nucleic acid, but is inactivated in terms of its ability to replicate in a normal lytic viral life cycle. See for example Berkner et al., BioTechniques, 6:616 (1988); Rosenfeld et al., Science, 252:431-434 (1991); and Rosenfeld et al., Cell, 68:143-155 (1992). Suitable adenoviral vectors derived from the adenovirus strain Ad type 5 d1324 or other strains of adenovirus (e.g., Adz, Ad3, Ad7 etc.) are well known to those skilled in the art. Recombinant adenoviruses are advantageous in that they do not require dividing cells to be effective gene delivery vehicles and can be used to infect a wide variety of cell types, including airway epithelium (Rosenfeld et al. (1992) cited supra), endothelial cells (Lemarchand et al., Proc. Natl. Acad. Sci. USA, 89):6482-6486 (1992)), hepatocytes (Herz and Gerard, Proc. Natl. Acad. Sci. USA, 90:2812-2816 (1993)) and muscle cells (Quantin et al., Proc. Natl. Acad. Sci. USA, 89:2581-2584 (1992)).

Adeno-associated virus (AAV) is a naturally occurring defective virus that requires another virus, such as an adenovirus or a herpes virus, as a helper virus for efficient replication and a productive life cycle. (For a review see Muzyczka et al., Curr. Topics in Micro. and Immunol., 158:97-129 (1992)). It exhibits a high frequency of stable integration (see for example Flotte et al., Am. J. Respir. Cell. Mol. Biol., 7:349-356 (1992); Samulski et al., J. Virol., 63:3822-3828 (1989); and McLaughlin et al., J. Virol, 62:1963-1973 (1989); Flotte, et al., Gene Ther., 2:29-37 (1995); Zeitlin, et al., Gene Ther., 2:623-31 (1995); Baudard, et al, Hum. Gene Ther., 7:1309-22 (1996)). Vectors containing as little as 300 base pairs of AAV can be packaged and can integrate. Space for exogenous nucleic acid is limited to about 4.5 kb, well in excess of the overall size of the expression vectors of the invention. An AAV vector, such as that described in Tratschin et al., Mol. Cell. Biol., 5:3251-3260 (1985) can be used to introduce the expression vector into cells A variety of nucleic acids have been introduced into different cell types using AAV vectors (see for example Hermonat et al., Proc. Natl. Acad. Sci. USA, 81:6466-6470 (1984); Tratschin et al., Mol. Cell. Biol., 4:2072-2081 (1985); Wondisford et al., Mol. Endocrinol., 2:32-39 (1988); Tratschin et al., J. Virol., 51:611-619 (1984); and Flotte et al., J. Biol. Chem., 268: 3781-3790 (1993)).

A subject nucleic acid will in some embodiments be incorporated into lentiviral vectors. In this regard, see:_Qin et al. (2003) Proc. Natl. Acad. Sci. USA 100: 183-188; Miyoshi et al. (1998) J. Virol. 72: 8150-8157; Tisconia et al. (2003) Proc. Natl. Acad. Sci. USA 100:1.844-1848; and Pfeifer et al. (2002) Proc. Natl. Acad. Sci. USA 99: 2140-2145. Lentiviral vector kits are available from Invitrogen (Carlsbad, Calif.).

A subject recombinant vector will in some embodiments include one or more selectable markers. A number of selection systems may be used, including but not limited to the herpes simplex virus thymidine kinase (Wigler, et al., Cell, 11:223 (1977)), hypoxanthine-guanine phosphoribosyltransferase (Szybalska & Szybalski, Proc. Natl. Acad. Sci. USA, 48:2026 (1962)), and adenine phosphoribosyltransferase (Lowy et al., Cell, 22:817 (1980)) genes can be employed in tk⁻, hgprt⁻ or aprt⁻ cells, respectively. Also, antimetabolite resistance can be used as the basis of selection for dhfr, which confers resistance to methotrexate (Wigler et al., Natl. Acad. Sci. USA, 77:3567 (1980); O'Hare et al., Proc. Natl. Acad. Sci. USA, 78:1527 (1981)); gpt, which confers resistance to mycophenolic acid (Mulligan & Berg, Proc. Natl. Acad. Sci. USA, 78:2072 (1981)); neo, which confers resistance to the aminoglycoside G-418 (Colberre-Garapin et al., J. Mol. Biol., 150:1 (1981)); and hygro, which confers resistance to hygromycin (Santerre, et al., Gene, 30:147 (1984)). Recently, additional selectable genes have been described, namely trpB, which allows cells to utilize indole in place of tryptophan; hisD, which allows cells to utilize histinol in place of histidine (Hartman & Mulligan, Proc. Natl. Acad. Sci. USA, 85:8047 (1988)); and ODC (ornithine decarboxylase) which confers resistance to the ornithine decarboxylase inhibitor, 2-(difluoromethyl)-DL-ornithine, DFMO (McConlogue L., 1987, In: Current Communications in Molecular Biology, Cold Spring Harbor Laboratory ed.).

Introducing a Recombinant Vector into a Host Cell

A subject recombinant vector may be introduced into a host cell utilizing a vehicle, or by various physical methods. Representative examples of such methods include transformation using calcium phosphate precipitation (Dubensky et al., PNAS, 81:7529-7533 (1984)), direct microinjection of such nucleic acid molecules into intact target cells (Acsadi et al., Nature, 352:815-818 (1991)), and electroporation whereby cells suspended in a conducting solution are subjected to an intense electric field in order to transiently polarize the membrane, allowing entry of the nucleic acids. Other procedures include the use of nucleic acid molecules linked to an inactive adenovirus (Cotton et al., PNAS, 89:6094 (1990)), lipofection (Felgner et al., Proc. Natl. Acad. Sci. USA, 84:7413-7417 (1989)), microprojectile bombardment (Williams et al., PNAS, 88:2726-2730 (1991)), polycation compounds such as polylysine, receptor specific ligands, liposomes entrapping the nucleic acid molecules, and spheroplast fusion whereby *E. coli* containing the nucleic acid molecules are stripped of their outer cell walls and fused to animal cells using polyethylene glycol.

Variant Sulfatase Polypeptides

Therapeutic sulfatase polypeptides include variant sulfatase polypeptides that inhibit the activity of an endogenous sulfatase (e.g., an endogenous HSulf-1 or an endogenous HSulf-2), e.g., by inhibiting binding of an endogenous sulfatase to a cell surface, by inhibiting the ability of an endogenous sulfatase to activate Wnt, etc. In some embodiments, a subject variant sulfatase polypeptide comprises all or a portion of the hydrophilic domain of HSulf-1 or HSulf-2. For example, the hydrophilic domain of HSulf-1 includes amino acids 415-735 of SEQ ID NO:3; and the hydrophilic domain of HSulf-2 includes amino acids 416-715 of SEQ ID NO:6.

In some embodiments, a subject sulfatase variant polypeptide comprises from about 20 to about 50, from about 50 to about 75, from about 75 to about 100, from about 100 to about 150, from about 150 to about 200, from about 200 to about 250, or from about 250 to about 300 contiguous amino acids of amino acids 415-735 of SEQ ID NO:3, or amino acids 416-715 of SEQ ID NO:6.

In some embodiments, a subject sulfatase polypeptide includes from about amino acid 415 to about amino acid 440, from about amino acid 440 to about amino acid 465, from about amino acid 465 to about amino acid 490, from about amino acid 490 to about amino acid 515, from about amino acid 515 to about amino acid 540, from about amino acid 540 to about amino acid 565, from about amino acid 565 to about amino acid 590, from about amino acid 590 to about amino acid 615, from about amino acid 615 to about amino acid 640, from about amino acid 640 to about amino acid 665, from about amino acid 665 to about amino acid 690, from about amino acid 690 to about amino acid 715, or from about amino acid 715 to about amino acid 735 of SEQ ID NO:3. In other embodiments, a subject sulfatase polypeptide includes from about amino acid 416 to about amino acid 440, from about amino acid 440 to about amino acid 465, from about amino acid 465 to about amino acid 490, from about amino acid 490 to about amino acid 515, from about amino acid 515 to about amino acid 540, from about amino acid 540 to about amino acid 565, from about amino acid 565 to about amino acid 590, from about amino acid 590 to about amino acid 615, from about amino acid 615 to about amino acid 640, from about amino acid 640 to about amino acid 665, from about amino acid 665 to about amino acid 690, or from about amino acid 690 to about amino acid 715 of SEQ ID NO:6.

In some embodiments, the sulfatase domain, if present, is catalytically inactive. The sulfatase domain can be rendered catalytically inactive by, e.g., mutating cysteines 87 and 88 of HSulf-1 or cysteines 88 and 89 of HSulf-2 to alanine.

In some embodiments, a subject variant sulfatase polypeptide lacks one or more of a sulfatase domain, a G6 S-related region, and a coiled-coil region. In some embodiments, a subject variant sulfatase polypeptide lacks a sulfatase domain, e.g., lacks all or part of amino acids 42-414 of SEQ ID NO:3 or all or part of amino acids 43-415 of SEQ ID NO:6.

In some embodiments, a subject variant sulfatase includes a sulfatase hydrophilic domain or fragment thereof, linked to a heterologous protein, e.g., a non-sulfatase protein (e.g., a fusion partner) to form a fusion protein. Suitable fusion partners include peptides and polypeptides that confer enhanced stability in vivo (e.g., enhanced serum half-life); provide ease of purification, e.g., (His)ₙ, e.g., 6His, and the like; provide for secretion of the fusion protein from a cell; provide an epitope tag, e.g., GST, hemagglutinin (HA; e.g., CYPYDVPDYA; SEQ ID NO:19), FLAG (e.g., DYKDDDK; SEQ ID NO:20), c-myc (e.g., CEQKLISEEDL; SEQ ID NO:21), and the like; provide a detectable signal, e.g., an enzyme that generates a detectable product (e.g., β-galactosidase, luciferase), or a protein that is itself detectable, e.g., a green fluorescent protein, etc.; provides for multimerization, e.g., a multimerization domain such as an Fc portion of an immunoglobulin; and the like.

A fusion protein may comprise an amino acid sequence that provides for secretion of the fusion protein from the cell. Those skilled in the art are aware of such secretion signal sequences. Secretion signals that are suitable for use in bacteria include, but are not limited to, the secretion signal of Braun's lipoprotein of *E. coli, S. marcescens, E. amylosora, M morganii*, and *P. mirabilis*, the TraT protein of *E. coli* and *Salmonella*; the penicillinase (PenP) protein of *B. licheniformis* and *B. cereus* and *S. aureus*; pullulanase proteins of *Klebsiella pneumoniae* and *Klebsiella aerogenese; E. coli* lipoproteins 1 pp-28, Pal, Rp1A, Rp1B, OsmB, NlpB, and Orl17; chitobiase protein of *V. harseyi*; the β-1,4-endoglucanase protein of *Pseudomonas solanacearum*, the Pal and Pcp proteins of *H. influenzae*; the OprI protein of *P. aeruginosa*; the MalX and AmiA proteins of *S. pneumoniae*; the 34 kda antigen and TpmA protein of *Treponema pallidum*; the P37 protein of *Mycoplasma hyorhinis*; the neutral protease of *Bacillus amyloliquefaciens*; and the 17 kda antigen of *Rickettsia rickettsi*. Secretion signal sequences suitable for use in yeast are known in the art, and can be used. See, e.g., U.S. Pat. No. 5,712,113.

In some embodiments, a sulfatase variant comprises a fusion partner and a protease cleavage site that is positioned between the fusion partner and the remainder of the sulfatase polypeptide variant.

Proteolytic cleavage sites are known to those skilled in the art; a wide variety are known and have been described amply in the literature, including, e.g., *Handbook of Proteolytic Enzymes* (1998) A J Barrett, N D Rawlings, and J F Woessner, eds., Academic Press. Proteolytic cleavage sites include, but are not limited to, an enterokinase cleavage site: (Asp)$_4$Lys (SEQ ID NO:45); a factor Xa cleavage site: Ile-Glu-Gly-Arg (SEQ ID NO:46); a thrombin cleavage site, e.g., Leu-Val-Pro-Arg-Gly-Ser (SEQ ID NO:47); a renin cleavage site, e.g., His-Pro-Phe-His-Leu-Val-Ile-His (SEQ ID NO:48); a collagenase cleavage site, e.g., X-Gly-Pro (where X is any amino acid); a trypsin cleavage site, e.g., Arg-Lys; a viral protease cleavage site, such as a viral 2A or 3C protease cleavage site, including, but not limited to, a protease 2A cleavage site from a picornavirus (see, e.g., Sommergruber et al. (1994) *Virol.* 198:741-745), a Hepatitis A virus 3C cleavage site (see, e.g., Schultheiss et al. (1995) *J. Virol.* 69:1727-1733), human rhinovirus 2A protease cleavage site (see, e.g., Wang et al. (1997) *Biochem. Biophys. Res. Comm.* 235:562-566), and a picornavirus 3 protease cleavage site (see, e.g., Walker et al. (1994) *Biotechnol.* 12:601-605).

Formulations Suitable for Injection

A subject sulfatase variant polypeptide is in some embodiments formulated into a preparation suitable for injection (e.g., subcutaneous, intramuscular, intradermal, transdermal, or other injection routes) by dissolving, suspending or emulsifying the polypeptide in an aqueous solvent (e.g., saline, and the like) or a nonaqueous solvent, such as vegetable or other similar oils, synthetic aliphatic acid glycerides, esters of higher aliphatic acids or propylene glycol; and if desired, with conventional additives such as solubilizers, isotonic agents, suspending agents, emulsifying agents, stabilizers and preservatives.

Formulations for Enteral Delivery

For oral preparations, a subject sulfatase polypeptide variant is in some embodiments is formulated alone or in combination with appropriate additives to make tablets, powders, granules or capsules, for example, with conventional additives, such as lactose, mannitol, corn starch or potato starch; with binders, such as crystalline cellulose, cellulose derivatives, acacia, corn starch or gelatins; with disintegrators, such as corn starch, potato starch or sodium carboxymethylcellulose; with lubricants, such as talc or magnesium stearate; and if desired, with diluents, buffering agents, moistening agents, preservatives, and flavoring agents.

Furthermore, a subject sulfatase polypeptide variant can be made into suppositories by mixing with a variety of bases such as emulsifying bases or water-soluble bases. A subject sulfatase polypeptide variant can be administered rectally via a suppository. The suppository can include vehicles such as cocoa butter, carbowaxes and polyethylene glycols, which melt at body temperature, yet are solidified at room temperature.

Unit dosage forms for oral or rectal administration such as syrups, elixirs, and suspensions may be provided wherein each dosage unit, for example, teaspoonful, tablespoonful, tablet or suppository, contains a predetermined amount of the composition containing one or more sulfatase polypeptide variants. Similarly, unit dosage forms for injection or intravenous administration may comprise the agonist(s) in a composition as a solution in sterile water, normal saline or another pharmaceutically acceptable carrier.

For enteral delivery, a subject formulation will in some embodiments include an enteric-soluble coating material. Suitable enteric-soluble coating material include hydroxypropyl methylcellulose acetate succinate (HPMCAS), hydroxypropyl methyl cellulose phthalate (HPMCP), cellulose acetate phthalate (CAP), polyvinyl phthalic acetate (PVPA), Eudragit™, and shellac.

As one non-limiting example of a suitable oral formulation, a subject sulfatase polypeptide variant can be formulated together with one or more pharmaceutical excipients and coated with an enteric coating, as described in U.S. Pat. No. 6,346,269. For example, a solution comprising a solvent, a subject sulfatase polypeptide variant, and a stabilizer is coated onto a core comprising pharmaceutically acceptable excipients, to form an active agent-coated core; a sub-coating layer is applied to the active agent-coated core, which is then coated with an enteric coating layer. The core generally includes pharmaceutically inactive components such as lactose, a starch, mannitol, sodium carboxymethyl cellulose, sodium starch glycolate, sodium chloride, potassium chloride, pigments, salts of alginic acid, talcs titanium dioxide, stearic acid, stearate, micro-crystalline cellulose, glycerin, polyethylene glycol, triethyl citrate, tributyl citrate, propanyl triacetate, dibasic calcium phosphate, tribasic sodium phosphate, calcium sulfate, cyclodextrin, and castor oil. Suitable solvents for the active agent include aqueous solvents. Suitable stabilizers include alkali-metals and alkaline earth metals, bases of phosphates and organic acid salts and organic amines. The sub-coating layer comprises one or more of an adhesive, a plasticizer, and an anti-tackiness agent. Suitable anti-tackiness agents include talc, stearic acid, stearate, sodium stearyl fumarate, glyceryl behenate, kaolin and aerosil. Suitable adhesives include polyvinyl pyrrolidone (PVP), gelatin, hydroxyethyl cellulose (HCE), hydroxypropyl cellulose (HPC), hydroxypropyl methyl cellulose (HPMC), vinyl acetate (VA), polyvinyl alcohol (PVA), methyl cellulose (MC), ethyl cellulose (EC), hydroxypropyl methyl cellulose phthalate (HPMCP), cellulose acetate phthalates (CAP), xanthan gum, alginic acid, salts of alginic acid, Eudragit™, copolymer of methyl acrylic acid/methyl methacrylate with polyvinyl acetate phthalate (PVAP). Suitable plasticizers include glycerin, polyethylene glycol, triethyl citrate, tributyl citrate, propanyl triacetate and castor oil. Suitable enteric-soluble coating material include hydroxypropyl methylcellulose acetate succinate (HPMCAS), hydroxypropyl methyl cellulose phthalate(HPMCP), cellulose acetate phthalate (CAP), polyvinyl phthalic acetate (PVPA), Eudragit™ and shellac.

Suitable oral formulations also include a subject sulfatase polypeptide variant formulated with any of the following: microgranules (see, e.g., U.S. Pat. No. 6,458,398); biodegradable macromers (see, e.g., U.S. Pat. No. 6,703,037); biodegradable hydrogels (see, e.g., Graham and McNeill (1989) *Biomaterials* 5:27-36); biodegradable particulate vectors (see, e.g., U.S. Pat. No. 5,736,371); bioabsorbable lactone polymers (see, e.g., U.S. Pat. No. 5,631,015); slow release protein polymers (see, e.g., U.S. Pat. No. 6,699,504; Pelias Technologies, Inc.); a poly(lactide-co-glycolide/polyethylene glycol block copolymer (see, e.g., U.S. Pat. No. 6,630,155; Atrix Laboratories, Inc.); a composition comprising a biocompatible polymer and particles of metal cation-stabilized agent dispersed within the polymer (see, e.g., U.S. Pat. No. 6,379,701; Alkermes Controlled Therapeutics, Inc.); and microspheres (see, e.g., U.S. Pat. No. 6,303,148; Octoplus, B. V.).

Suitable oral formulations also include a subject sulfatase polypeptide variant formulated with any of the following: a carrier such as Emisphere® (Emisphere Technologies, Inc.); TIMERx, a hydrophilic matrix combining xanthan and locust bean gums which, in the presence of dextrose, form a strong binder gel in water (Penwest); Geminex™ (Penwest); Procise™ (GlaxoSmithKline); SAVIT™ (Mistral Pharma Inc.); RingCap™ (Alza Corp.); Smartrix® (Smartrix Technologies, Inc.); SQZgel™ (MacroMed, Inc.); Geomatrix™ (Skye Pharma, Inc.); Oros® Tri-layer (Alza Corporation); and the like.

Also suitable for use are formulations such as those described in U.S. Pat. No. 6,296,842 (Alkermes Controlled Therapeutics, Inc.); U.S. Pat. No. 6,187,330 (Scios, Inc.); and the like.

Additional oral formulations suitable for use herein include a subject sulfatase polypeptide variant formulated with a carrier for oral delivery, e.g., as described in WO 03/066859. For example, a suitable oral formulation includes a subject sulfatase polypeptide variant and a penetrating peptide (also referred to as a "peptide carrier"). A penetrating peptide is any peptide that facilitates translocation of a substance across a biological barrier, e.g., the epithelial layer lining the gastrointestinal tract. Suitable peptide carriers include those derived from various proteins including, but not limited to, an integral membrane protein, a bacterial toxin, a non-pathogenic bacterium, a viral protein, an extracellular protein, and the like. The amino acid sequence of the peptide carrier can be the same as the amino acid sequence of a naturally-occurring peptide, or may be an altered version of such a peptide (e.g., including one or more amino acid substitutions compared to a naturally-occurring peptide).

Peptide carriers are typically from about 10 amino acids to about 30 amino acids in length, e.g., from about 10 amino acids to about 15 amino acids, from about 15 amino acids to about 20 amino acids, from about 20 amino acids to about 25 amino acids, or from about 25 amino acids to about 30 amino acids in length. Suitable peptide carriers include, but are not limited to, any one of the peptides shown in Table 1 of WO 03/06685.

The peptide carrier may be "associated with" (also referred to as "fused to," "coupled to," "linked to," or "attached to") a subject sulfatase variant polypeptide in any of a number of ways, including, e.g., via a covalent interaction, an ionic interaction, a hydrophobic interaction, a hydrogen bond, or other type of association (e.g., van der Waals interaction; a non-specific association due to solvent preference; and the like). Attachment of a peptide carrier to a subject sulfatase variant polypeptide is achieved by any chemical, biochemical, enzymatic, or genetic coupling method known to those skilled in the art.

If the peptide carrier is coupled to the desired protein, typically the N-terminus of the desired protein is coupled to the carboxyl terminus of the peptide carrier. A subject sulfatase variant polypeptide may be coupled to the peptide carrier directly or indirectly via a covalent bond. For example, the covalent bond may be a peptide bond; or the covalent bond may be achieved by a homo- or a hetero-functional bridging reagent. The bridging reagent may be a succinimidyl-(N-maleimidomethyl)cyclohexane-1-carboxylate (SMCC)-type carrier. The covalent bond may be achieved using a peptide linker.

In some embodiments, a subject sulfatase variant polypeptide is coupled to the peptide carrier via a linker peptide, which may be cleavable. The linker peptide may have any of a variety of amino acid sequences. Proteins can be joined by a spacer peptide, generally of a flexible nature, although other chemical linkages are not excluded. Exemplary linker sequences will generally be peptides of between about 6 and about 40 amino acids in length, or between about 6 and about 25 amino acids in length. These linkers are generally produced by using synthetic, linker-encoding oligonucleotides to couple the proteins. Peptide linkers with a degree of flexibility will generally be preferred. The linking peptides may have virtually any amino acid sequence, bearing in mind that linkers will typically have a sequence that results in a generally flexible peptide. The use of small amino acids, such as glycine and alanine, are of use in creating a flexible peptide. The creation of such sequences is routine to those of skill in the art. A variety of different linkers are commercially available and are considered suitable for use according to the present invention.

Exemplary linkers for use herein have a combination of glycine, alanine, proline and methionine residues, such as AAAGGM (SEQ ID NO:49); AAAGGMPPAAAGGM (SEQ ID NO:50); AAAGGM (SEQ ID NO:51); and PPAAAGGM$_2$ (SEQ ID NO:52). However, any flexible linker generally between about 6 and about 40 amino acids in length may be used. Linkers may have virtually any sequence that results in a generally flexible peptide, including alanine-proline rich sequences.

Dosages

The amount of subject agent (siRNA-encoding nucleic acid, variant sulfatase polypeptide, small molecule inhibitor, etc.) which is administered will vary with the nature of the agent. As one non-limiting example, a subject agent can be administered in the range of about 0.2 mg/kg/day to about 20 mg/kg/day. The determination of how large a dose is to be used may be determined using an animal model (e.g., a non-human primate model) and relating the dosage based on pharmacokinetics, e.g. with equations predictive of interspecies scaling. Usually, the lowest effective dose will be used.

In some embodiments, a single dose of an active agent is administered. In other embodiments, multiple doses of an active agent are administered. Where multiple doses are administered over a period of time, an active agent is administered twice daily (qid), daily (qd), every other day (qod), every third day, three times per week (tiw), or twice per week (biw) over a period of time. For example, an active agent is administered qid, qd, qod, tiw, or biw over a period of from one day to about 2 years or more. For example, an active agent is administered at any of the aforementioned frequencies for one week, two weeks, one month, two months, six months, one year, or two years, or more, depending on various factors.

Therapeutic Methods

The instant invention provides various therapeutic methods. In some embodiments, methods of regulating, including modulating and inhibiting, enzymatic activity of the subject proteins are provided. The subject methods find use in the treatment of a variety of different disease conditions, including, but not limited to, cancer; inflammation; disorders amenable to treatment by increasing angiogenesis, such as ischemic disorders; and thrombosis.

The host, or patient, may be from any mammalian species, e.g. primate sp., particularly humans; rodents, including mice, rats and hamsters; rabbits; equines, bovines, canines, felines; etc. Animal models are of interest for experimental investigations, providing a model for treatment of human disease.

As used herein, the term "agent" refers to a substance that modulates a level of enzymatically active subject sulfatase. In some embodiments, an agent is one identified by a screening assay of the invention. "Modulating a level of enzymatically active subject sulfatase" includes increasing or decreasing enzymatic activity of a subject sulfatase; increasing or decreasing substrate recognition by a subject sulfatase;

increasing or decreasing binding of a coiled-coil domain of a subject sulfatase to a second protein; reducing furin-mediated processing of a subject sulfatase; increasing or decreasing a level of enzymatically active sulfatase protein; and increasing or decreasing a level of mRNA encoding enzymatically active subject sulfatase. In some embodiments, an agent is a subject sulfatase, where the subject sulfatase itself is administered to an individual. In some embodiments, an agent is an antibody specific for a subject sulfatase.

Methods of Reducing Tumor Growth

Disease conditions amenable to treatment by reducing an activity of a subject sulfatase and/or reducing a level of a subject sulfatase polypeptide or mRNA include those disease conditions associated with or resulting from the promotion of angiogenesis by a tumor. Thus, the subject methods are useful for reducing tumor-induced angiogenesis. In some embodiments, methods are provided for treating cancer. In some of these embodiments, methods are provided for reducing tumor growth. In other embodiments, methods are provided for reducing release of differentiation factors from the ECM.

In some embodiments, the present invention provides for reducing tumor growth in autocrine Wnt signaling cancers such as multiple myeloma, breast cancer, pancreatic cancer, and lung cancer, where the cancerous cells utilize autocrine Wnt signaling for proliferation. The methods generally involve administering to an individual suffering from an autocrine Wnt signaling cancer an effective amount of a subject agent, e.g., an antibody or functional fragment thereof that inhibits binding of a sulfatase (e.g., HSulf-1, HSulf-2, etc.) to the cell surface plasma membrane; a variant sulfatase polypeptide that inhibits binding of a sulfatase (e.g., HSulf-1, HSulf-2, etc.) to the cell surface plasma membrane; an siRNA that reduces the level of a sulfatase (e.g., HSulf-1, HSulf-2, etc.) produced by a cell; a small molecule that inhibits binding of a sulfatase (e.g., HSulf-1, HSulf-2, etc.) to the cell surface plasma membrane; etc.

Methods of reducing tumor growth, methods of reducing tumor-induced angiogenesis, and methods of reducing subject sulfatase activity, generally comprise administering to an individual an agent that reduces a level of enzymatically active subject sulfatase. An effective amount of an agent reduces the level of enzymatically active sulfatase by at least about 10%, at least about 20%, at least about 30%, at least about 40%, at least about 50%, or more, when compared to a suitable control. An effective amount of an agent reduces tumor growth by at least about 10%, at least about 20%, at least about 30%, at least about 40%, at least about 50%, or more, when compared to a suitable control.

Methods of reducing release of factors, such as growth factors and differentiation factors, from ECM and the cell surface are provided. The methods generally comprise administering to an individual an effective amount of an agent that reduces a level of enzymatically active subject sulfatase, or reduces the enzymatic activity of the sulfatase, where a reduction in the level of enzymatically active sulfatase results in a reduction of release of factor from the ECM adjacent to or surrounding the tumor or from the cell surface of the cancer cell itself.

Differentiation and growth factors include, but are not limited to, a fibroblast growth factor (FGF), a heparin-binding EGF-like growth factor, a hepatocyte growth factor, a member of the Wnt family of secreted glycoproteins, vascular endothelial growth factor (VEGF), platelet-derived growth factor (PDGF), a transforming growth factor (TGF), e.g., TGF-β, a bone morphogenetic protein, GM-CSF, and hepatocyte growth factor. In some embodiments, a factor released from the ECM by a subject sulfatase is a factor that binds heparan sulfate. In some embodiments, a factor released from the ECM by a subject sulfatase is an angiogenic factor.

Tumors which may be treated using the methods of the instant invention include carcinomas, e.g. colon, prostate, breast, melanoma, ductal, endometrial, stomach, pancreatic, mesothelioma, dysplastic oral mucosa, invasive oral cancer, non-small cell Jung carcinoma, transitional and squamous cell urinary carcinoma, etc.; neurological malignancies, e.g. neuroblastoma, glioblastoma, astrocytoma, gliomas, etc.; hematological malignancies, e.g. childhood acute leukaemia, non-Hodgkin's lymphomas, chronic lymphocytic leukaemia, malignant cutaneous T-cells, mycosis fungoides, non-NF cutaneous T-cell lymphoma, lymphomatoid papulosis, T-cell rich cutaneous lymphoid hyperplasia, bullous pemphigoid, discoid lupus crythematosus, lichen planus, etc.; and the like.

Whether tumor cell growth is inhibited or reduced can be assessed by any means known in the art, including, but not limited to, measuring tumor size; determining whether tumor cells are proliferating, e.g., by using a $^3$H-incorporation assay; and/or counting tumor cells.

Methods for Reducing Inflammation

In some embodiments, the invention provides methods of reducing inflammation, comprising increasing a level of enzymatically active subject sulfatase. Sulfatases act to remove a sulfate group from carbohydrate moieties of selectin ligands. Once a sulfate group is removed from the selectin ligand (e.g. from N-acetylglucosamine 6-sulfate), binding of the selectin to the ligand is reduced, and binding between an immune cell which a selectin on its surface to an selectin ligand on, e.g., the surface of an endothelial cell, is reduced. Accordingly, removal of a sulfate group from a selectin ligand reduces inflammation. In some embodiments, the methods comprise administering a subject sulfatase to an individual. In other embodiments, the methods comprise administering an agent (e.g., an agent identified by a screening method described above) to an individual, wherein said agent is one that increases a level of enzymatically active subject sulfatase in the individual. A therapeutically effective amount an agent is an amount sufficient to remove sulfate moieties from a substantial proportional number of ligands so that inflammation can either be prevented or ameliorated. Thus, "treating" as used herein in the context of inflammation shall mean preventing or ameliorating inflammation and/or symptoms associated with inflammation.

In determining the dose of sulfatases or agents to be administered, it must be kept in mind that one does not wish to completely remove all sulfates. In order for a normal healing process to proceed, at least some of the white blood cells or neutrophils must be brought into the tissue in the areas where the wound, infection or disease state is occurring. The amount of the sulfatases or agent administered is adjusted based on the particular needs of the patient while taking into consideration a variety of factors such as the type of disease that is being treated.

The subject sulfatases and/or agents are useful to treat a wide range of diseases, including diseases such as rheumatoid arthritis, asthma, adult respiratory distress syndrome, sarcoidosis, hypersensitivity pneumonitis multiple sclerosis, allograft rejection, and the spread of lymphomas to cutaneous sites. The compositions of the invention should be applicable to treat any disease state wherein the immune system turns against the body causing the white cells to accumulate in the tissues to the extent that they cause tissue damage, swelling, inflammation and/or pain. The inflammation of rheumatoid arthritis, for example, is created when large numbers of white blood cells quickly enter the joints in the area of disease and attack the surrounding tissues.

Formulations of sulfatases and/or agent are administered to prevent the undesirable aftereffects of tissue damage resulting from heart attacks. When a heart attack occurs and the patient has been revived, such as by the application of anticoagulants or thrombolytic (e.g., tPA), the endothelial lining where a clot was formed has often suffered damage. When the antithrombotic has removed the clot, the damaged tissue beneath the clot and other damaged tissue in the endothelial lining which has been deprived of oxygen become activated. The white blood cells possess L-selectin. The receptors adhere to ligand molecules on the surface of activated endothelial cells. The ligand molecules may be induced to the surface of the endothelial cells by activation. Large numbers of white blood cells are quickly captured and brought into the tissue surrounding the affected area, resulting in inflammation, swelling and necrosis which thereby decreases the likelihood of survival of the patient.

In addition to treating patients suffering from the trauma resulting from heart attack, patients suffering from actual physical trauma could be treated with formulations of the invention in order to relieve the amount of inflammation and swelling which normally result after an area of the body is subjected to severe trauma. This is most preferably done by local injection of sulfatases and/or agent to the area subjected to trauma. Also, patients suffering from hemorrhagic shock could be treated to alleviate inflammation associated with restoring blood flow. Other disease states which might be treatable using formulations of the invention include various types of arthritis, various chronic inflammatory conditions of the skin, insulin-dependent diabetes, and adult respiratory distress syndrome. After reading the present disclosure, those skilled in the art will recognize other disease states and/or symptoms which might be treated and/or mitigated by the administration of formulations of the present invention.

Methods of Increasing Angiogenesis

In some embodiments, the invention provides methods for increasing angiogenesis. The methods generally involve administering to a mammal having a condition amenable to treatment by increasing angiogenesis an effective amount of a subject sulfatase. In many embodiments; the subject sulfatase will be administered locally to an anatomical site.

Examples of conditions and diseases amenable to treatment according to the method of the invention include any condition associated with an obstruction of a blood vessel, e.g., obstruction of an artery, vein, or of a capillary system. Specific examples of such conditions or disease include, but are not necessarily limited to, coronary occlusive disease, carotid occlusive disease, arterial occlusive disease, peripheral arterial disease, atherosclerosis, myointimal hyperplasia (e.g., due to vascular surgery or balloon angioplasty or vascular stenting), thromboangiitis obliterans, thrombotic disorders, vasculitis, and the like. Examples of conditions or diseases that can be prevented using the methods of the invention include, but are not necessarily limited to, any of a variety of ischemic conditions (e.g., myocardial ischemia, limb ischemia, ischemia associated with stroke), heart attack (myocardial infarction) or other vascular death, stroke, death or loss of limbs associated with decreased blood flow, and the like.

Thus, the invention provides methods of treating an ischemic condition. Administration of an effective amount of a subject sulfatase results in an increase in angiogenesis, and as a result, an increased blood supply to an ischemic tissue. Following administration of a subject sulfatase, blood supply (blood flow) to the ischemic tissue is increased by at least about 10%, at least about 20%, at least about 30%, at least about 50%, at least about 75%, or at least about 100%, or more when compared to a suitable control. Whether the blood supply to an ischemic tissue is increased can be measured by any method known in the art including, but not limited to, thermography; infrared recorder; transcutaneous $PO_2$, transcutaneous $PCO_2$, laser Doppler, Doppler waveform, ankle brachial index, pulse volume recording, toe pressure, duplex waveform, magnetic resonance imaging profile, isotope washout, and NAD/NADH fluorometry. Such methods are well known in the art and have been described in numerous publications, including, e.g., Lazarus et al. ((1994) *Arch. Dermatol.* 130:491) and references cited therein.

Whether angiogenesis is increased can be determined using any known assay. Whether angiogenesis is increased can be determined using any method known in the art, including, e.g., stimulation of neovascularization into implants impregnated with relaxin; stimulation of blood vessel growth in the cornea or anterior eye chamber; stimulation of endothelial cell proliferation, migration or tube formation in vitro; and the chick chorioallantoic membrane assay; the hamster cheek pouch assay; the polyvinyl alcohol sponge disk assay. Such assays are well known in the art and have been described in numerous publications, including, e.g., Auerbach et al. ((1991) *Pharmac. Ther.* 51:1-11), and references cited therein.

Methods of Reducing Thrombosis

The invention further provides methods of reducing thrombosis in an individual, the methods generally involving administering an effective amount of an inhibitor of a subject sulfatase. In some embodiments, the inhibitor is a small molecule inhibitor of sulfatase activity of a subject sulfatase. In other embodiments, the inhibitor is an antibody specific for a subject sulfatase, which antibody inhibits the sulfatase activity, either directly or by effecting removal of the sulfatase.

Formulations Dosages, and Routes of Administration

As mentioned above, an effective amount of the active agent (e.g., small molecule, anti-sulfatase antibody, or a subject sulfatase) is administered to the host, where "effective amount" means a dosage sufficient to produce a desired result. In some embodiments, the desired result is at least a reduction in enzymatic activity of a subject sulfatase as compared to a control. In other embodiments, the desired result is an increase in the level of enzymatically active sulfatase (in the individual, or in a localized anatomical site in the individual), as compared to a control.

Typically, the compositions of the instant invention will contain from less than 1% to about 95% of the active ingredient, preferably about 10% to about 50%. Generally, between about 100 mg and 500 mg will be administered to a child and between about 500 mg and 5 grams will be administered to an adult. Administration is generally by injection and often by injection to a localized area. The frequency of administration will be determined by the care given based on patient responsiveness. Other effective dosages can be readily determined by one of ordinary skill in the art through routine trials establishing dose response curves.

In order to calculate the amount of sulfatase enzyme, those skilled in the art could use readily available information with respect to the amount of enzyme necessary to remove a given amount of sulfatase. For example, if a given enzyme has an activity such that one unit of the enzyme removes 1 micromole/min. of $SO_4$ from a substrate at physiological pH, then one would administer from 1 to 10 units intravenously to a 70 kg. human for therapeutic purposes. The amount of an agent necessary to increase a level of enzymatically active subject sulfatase can be calculated from in vitro experimentation. For example, by calculating the amount of agent necessary to increase removal of sulfate groups from a given amount of substrate and estimating the amount of such substrate (or its in vivo equivalent) within the area to be treated, an amount of agent to be administered can be determined. The amount of agent will, of course, vary depending upon the particular agent used.

In the subject methods, the active agent(s) may be administered to the host using any convenient means capable of resulting in the desired inhibition of sulfatase activity. Thus, the agent can be incorporated into a variety of formulations for therapeutic administration. More particularly, the agents of the present invention can be formulated into pharmaceutical compositions by combination with appropriate, pharmaceutically acceptable carriers or diluents, and may be formulated into preparations in solid, semi-solid, liquid or gaseous forms, such as tablets, capsules, powders, granules, ointments, solutions, suppositories, injections, inhalants and aerosols.

As such, administration of the agents can be achieved in various ways, including oral, buccal, rectal, parenteral, intraperitoneal, intradermal, transdermal, intracheal, etc., administration.

In pharmaceutical dosage forms, the agents may be administered in the form of their pharmaceutically acceptable salts, or they may also be used alone or in appropriate association, as well as in combination, with other pharmaceutically active compounds. The following methods and excipients are merely exemplary and are in no way limiting.

For oral preparations, the agents can be used alone or in combination with appropriate additives to make tablets, powders, granules or capsules, for example, with conventional additives, such as lactose, mannitol, corn starch or potato starch; with binders, such as crystalline cellulose, cellulose derivatives, acacia, corn starch or gelatins; with disintegrators, such as corn starch, potato starch or sodium carboxymethylcellulose; with lubricants, such as talc or magnesium stearate; and if desired, with diluents, buffering agents, moistening agents, preservatives and flavoring agents.

Suitable excipient vehicles are, for example, water, saline, dextrose, glycerol, ethanol, or the like, and combinations thereof. In addition, if desired, the vehicle may contain minor amounts of auxiliary substances such as wetting or emulsifying agents or pH buffering agents. Actual methods of preparing such dosage forms are known, or will be apparent, to those skilled in the rt. See, e.g., Remington's Pharmaceutical Sciences, Mack Publishing Company, Easton, Pa., 17th edition, 1985. The composition or formulation to be administered will, in any event, contain a quantity of the chlorate/selenate and/or sulfatase adequate to achieve the desired state in the subject being treated.

The agents can be formulated into preparations for injection by dissolving, suspending or emulsifying them in an aqueous or nonaqueous solvent, such as vegetable or other similar oils, synthetic aliphatic acid glycerides, esters of higher aliphatic acids or propylene glycol; and if desired, with conventional additives such as solubilizers, isotonic agents, suspending agents, emulsifying agents, stabilizers and preservatives.

The agents can be utilized in aerosol formulation to be administered via inhalation. The compounds of the present invention can be formulated into pressurized acceptable propellants such as dichlorodifluoromethane, propane, nitrogen and the like.

Furthermore, the agents can be made into suppositories by mixing with a variety of bases such as emulsifying bases or water-soluble bases. The compounds of the present invention can be administered rectally via a suppository. The suppository can include vehicles such as cocoa butter, carbowaxes and polyethylene glycols, which melt at body temperature, yet are solidified at room temperature.

Unit dosage forms for oral or rectal administration such as syrups, elixirs, and suspensions may be provided wherein each dosage unit, for example, teaspoonful, tablespoonful, tablet or suppository, contains a predetermined amount of the composition containing one or more inhibitors. Similarly, unit dosage forms for injection or intravenous administration may comprise the inhibitor(s) in a composition as a solution in sterile water, normal saline or another pharmaceutically acceptable carrier.

The term "unit dosage form," as used herein, refers to physically discrete units suitable as unitary dosages for human and animal subjects, each unit containing a predetermined quantity of compounds of the present invention calculated in an amount sufficient to produce the desired effect in association with a pharmaceutically acceptable diluent, carrier or vehicle. The specifications for the novel unit dosage forms of the present invention depend on the particular compound employed and the effect to be achieved, and the pharmacodynamics associated with each compound in the host.

The pharmaceutically acceptable excipients, such as vehicles, adjuvants, carriers or diluents, are readily available to the public. Moreover, pharmaceutically acceptable auxiliary substances, such as pH adjusting and buffering agents, tonicity adjusting agents, stabilizers, wetting agents and the like, are readily available to the public.

Where the agent is a polypeptide, polynucleotide, analog or mimetic thereof, e.g. antisense composition, it may be introduced into tissues or host cells by any number of routes, including viral infection, microinjection, or fusion of vesicles. Jet injection may also be used for intramuscular administration, as described by Furth et au (1992), *Anal Biochem* 205:365-368. The DNA may be coated onto gold microparticles, and delivered intradermally by a particle bombardment device, or "gene gun" as described in the literature (see, for example, Tang et al. (1992), *Nature* 356:152-154), where gold microprojectiles are coated with the therapeutic DNA, then bombarded into skin cells.

Those of skill will readily appreciate that dose levels can vary as a function of the specific compound, the severity of the symptoms and the susceptibility of the subject to side effects. Preferred dosages for a given compound are readily determinable by those of skill in the art by a variety of means.

By treatment is meant at least an amelioration of the symptoms associated with the pathological condition afflicting the host, where amelioration is used in a broad sense to refer to at least a reduction in the magnitude of a parameter, e.g. symptom, associated with the pathological condition being treated, such as inflammation and pain associated therewith. As such, treatment also includes situations where the pathological condition, or at least symptoms associated therewith, are completely inhibited, e.g. prevented from happening, or stopped, e.g. terminated, such that the host no longer suffers from the pathological condition, or at least the symptoms that characterize the pathological condition.

A variety of hosts are treatable according to the subject methods. Generally such hosts are "mammals" or "mammalian," where these terms are used broadly to describe organisms which are within the class mammalia, including the orders carnivore (e.g., dogs and cats), rodentia (e.g., mice, guinea pigs, and rats), and primates (e.g., humans, chimpanzees, and monkeys). In many embodiments, the hosts will be humans.

The various sulfatases and agent of the present invention can be used by themselves, with each other, or in combination with pharmaceutically acceptable excipient materials as described above.

Kits with unit doses of the active agent, usually in oral or injectable doses, are provided. In such kits, in addition to the containers containing the unit doses will be an informational package insert describing the use and attendant benefits of the drugs in treating pathological condition of interest. Preferred compounds and unit doses are those described herein above.

EXAMPLES

The following examples are put forth so as to provide those of ordinary skill in the art with a complete disclosure and description of how to make and use the present invention, and are not intended to limit the scope of what the inventors regard as their invention nor are they intended to represent that the experiments below are all or the only experiments performed. Efforts have been made to ensure accuracy with respect to numbers used (e.g. amounts, temperature, etc.) but some experimental errors and deviations should be accounted for. Unless indicated otherwise, parts are parts by weight, molecular weight is weight average molecular weight, temperature is in degrees Celsius, and pressure is at or near atmospheric. Standard abbreviations may be used, e.g., bp, base pair(s); kb, kilobase(s); pl, picoliter(s); s or sec, second(s); min, minute(s); h or hr, hour(s); aa, amino acid(s); kb, kilobase(s); bp, base pair(s); nt, nucleotide(s); i.m., intramuscular(ly); i.p., intraperitoneal(ly); s.c., subcutaneous(ly); and the like.

Example 1

Identification of Novel Human Sulfatase-Encoding Nucleic Acid Molecules

HuSULF-1 and huSULF-2 sequences were derived based on a partial protein sequence (15 amino acids), and using a BLAST (i.e., tblastn) search of the NCBI public database to find expressed sequence tags that overlapped with the protein sequence. The new ESTs were then used to find additional corresponding ESTs and genomic sequences from public databases. A contig was assembled to yield a full-length cDNA. A full-length cDNA sequence corresponding to human sulf2, which is highly related to human sulf-1, was identified from human ESTs and genomic sequences. From the cDNAs for the two genes, we derived predicted protein sequences. The nucleotide sequence of huSULF-1 cDNA is provided in FIGS. 1A and 1B; the amino acid sequence of huSULF-1 is provided in FIG. 1C. The nucleotide sequence of huSULF-2 cDNA is provided in FIGS. 2A and 2B; the amino acid sequence of huSULF-2 is provided in FIG. 2C.

Using a similar approach, we derived full-length sequences of mouse SULF-1 and mouse SULF-2. The nucleotide sequence of mouse SULF-1 cDNA is provided in FIGS. 3A and 3B; the amino acid sequence of mouse SULF-1 is provided in FIG. 3C. The nucleotide sequence of mouse SULF-2 cDNA is provided in FIGS. 4A and 4B; the amino acid sequence of mouse SULF-2 is provided in FIG. 4C.

Example 2

Determining the Frequency of Expression of huSULF-1 and huSULF-2 in Normal and Cancerous Tissues Expressed Sequence Tags (EST)

The electronic northerns were accomplished as follows. The Genbank huEST database was subjected to a BLAST search (blastn) with the full length cDNAs of human sulf-1 and human sulf-2 respectively. Only those hits with p<1E-100 (perfect matches) were collected (total of 98 for either huSULF). At this stringency there were no redundant ESTs that mapped to both isozymes. The source of each EST was determined by examining every single pertinent GenBank record and tabulating the results. Similar sources such as glioblastoma and brain cancer were pooled. The results are shown in FIGS. 5, 6, and 7. The results indicate that huSULF1 and huSULF2 are expressed at elevated levels in cancerous tissue, when compared to normal, non-cancerous tissue.

SAGE

Serial analysis of gene expression, or SAGE, is a technique designed to take advantage of high-throughput sequencing technology to obtain a quantitative profile of cellular gene expression. Essentially, the SAGE technique measures not the expression level of a gene, but quantifies a "tag" which represents the transcription product of a gene. A tag, for the purposes of SAGE, is a nucleotide sequence of a defined length, directly 3'-adjacent to the 3'-most restriction site for a particular restriction enzyme. As originally described, the length of the tag was nine bases, and the restriction enzyme NlaIII. Current SAGE protocols produce a ten to eleven base tag, and, although NlaIII remains the most widely used restriction enzyme, enzyme substitutions are possible. The data product of the SAGE technique is a list of tags, with their corresponding count values, and thus is a digital representation of cellular gene expression. Velculescu V E, Zhang L, Vogelstein B, Kinzler K W. Serial analysis of gene expression. *Science.* 1995 Oct. 20; 270(5235):484-7; and Zhang L, Zhou W, Velculescu V E, Kern S E, Hruban R H, Hamilton S R, Vogelstein B, Kinziler K W. Gene expression profiles in normal and cancer cells. *Science.* 1997 May 23; 276(5316): 1268-72. There are currently approximately 3×10$^6$ SAGE tags from about 80 libraries.

SAGE libraries were examined for the presence of huSULF2 sequences. Libraries corresponding to normal and cancerous tissues (both cell lines and tissue samples) were analyzed. The results are shown in Table 1. The number of total available SAGE tags is provided, as well as the number of available tags that contain huSULF2 sequence.

TABLE 1

|  | Normal | Cancerous |
| --- | --- | --- |
| BREAST | | |
| Total available | 136,256 | 279,790 |
| huSULF2 | 14 | 180 |
| COLON | | |
| Total available | 235,923 | 621,404 |
| huSULF2 | 15 | 196 |

The data provided in Table 1 indicate that both huSULF1 and huSULF2 are highly expressed in cancerous cells.

Example 3

SAGE Analysis of huSULF-1 and huSULF-2

When SAGE analysis was applied to the human sulf-1 and sulf-2, there were striking findings. In the case of hsulf-1, significantly more tags were found in cancer tissue (normalized to specific tags per million of total tags) compared to normal tissue for both pancreas and prostate. The results are shown in FIG. 8.

In the case of sulf-2, the findings were even more dramatic. For 4 different cancers (pancreas, breast, central nervous system, and colon), the normalized tag representation (based on specific tags per million of total tags) was significantly higher in the cancer tissue as compared to the normal counterpart tissue. The results were most dramatic for breast cancer. Here the expression in the cancer tissue was extremely high, about 6-fold higher than in any of the other cancer tissues, and furthermore the level in breast cancer tissue was 17-fold higher than in normal breast tissue. The results are shown in FIG. 9.

These results indicate the upregulation of sulf gene expression in human cancers, with one or the other sulf gene more important depending on the nature of the cancer. Thus, the sulf gene products—extracellular sulfatase enzymes are appropriate targets for cancer therapy. Inhibition of these enzymes blocks the growth of tumors by preventing the release of growth factors or blocks the formation of new blood vessels associated with tumor growth (angiogenesis) and therefore prevents the growth and metastasis of the tumors.

Example 4 cDNA Cloning

Human SULF2

A 4286 bp cDNA was identified, and isolated from a human lung cDNA library and sequenced along both strands. This cDNA contains a 2613 bp open reading frame (ORF) that encodes an 870 amino acid polypeptide termed human SULF2. The human SULF2 gene is situated on human chromosome 20q12-13.2 since a genomic clone containing exons 11 through 20 of this gene has been localized to this region previously (Genbank accession no. AL034418). The nucleotide sequence of huSULF-2 cDNA is provided in FIGS. 10Ai and 10Aii; the amino acid sequence of huSULF-2 is provided in FIG. 10B.

Mouse SULF2

A cDNA encoding the mouse homologue of human SULF2 was identified in IMAGE clone 3155559 (Genbank accession no. AW763993) derived from a mouse mammary tumor. This clone was retrieved and DNA was prepped and sequenced along both strands. It was found to contain a 3613 bp cDNA containing a 2628 bp ORF encoding an 875 amino acid protein termed mouse SULF2 that is 94.6% identical to human SULF2 on the amino acid level (GCG-BESTFIT). The nucleotide sequence of mouse SULF-2 cDNA is provided in FIGS. 11A-11B; the amino acid sequence of mouse SULF-2 is provided in FIG. 11C.

Example 5

Genomic Organization of the Human SULF2 Gene

Fragments of the human SULF2 cDNA were used to screen the Genbank nr and htgs databases for matching genomic fragments. The retrieved matches were then assembled using the Sequencher contig alignment software. Thus four contigs (I, II, III, and IV) were assembled that contain the entire huSULF2 cDNA as 21 exons. The concanated sequence is provided in SEQ ID NO:22. The three gaps separating the four contigs are indicated by trains of N(NNNNNNNNNN). The length of these three gaps is presently unknown. The genomic organization of the gene was determined. The lengths, relative positions, and separating gaps of all 21 exons are shown in FIG. 12. Contig I is expected to contain regulatory elements (promoter and enhancer sequences) upstream of exon 1.

Example 6

Analysis of Protein Structure

FIG. 13 shows the structure of huSULF-1 and huSULF-2 proteins. Human sulf-1 is 871 amino acids and human sulf-2 is 870 amino acids in length. Hu-SULF1 and huSULF-2 are 65% identical at the amino acid level. Both have cleavable signal sequences at the amino termini of the proteins: 1-22 amino acids for sulf-1 and 1-24 amino acids for sulf-2. This feature indicates that these enzymes are secreted from the cells of origin (in contrast to the lysosomal glucosamine-6-sulfatase enzyme) and are present in the extracellular space where they can act on extracellular heparan sulfate proteoglycans and related glycoconjugates. Following the signal sequences are "sulfatase" domains which extend to about amino acid 400. This "sulfatase" designation is based on a block analysis of the protein. In this region, the closest homologue is the lysosomal glucosamine-6-sulfatase, which shows about 49% identity at the amino acid level to sulf proteins over this region (24-400 amino acids). Thus the sulf proteins are glucosamine-6-sulfatase enzymes with activity against heparan sulfate glycosaminoglycans and related glycoconjugates.

Within the first sulfatase domains are cleavage sites for the furin/PACE protease processing enzymes. This cleavage occurs between residues 408 (arginine) and 409 (aspartic acid) and/or between 576 (arginine) and 577 (histidine), and/or between 661 (arginine) and 662 (glutamic acid), and/or between 669 (arginine) and 670 (arginine), and/or between 732 (arginine) and 733 (glutamine) of hsulf-1. The cleavage occurs between 409 (arginine) and 410 (aspartic acid) and/or between 423 (arginine) and 424 (aspartic acid) and/or between 538 (arginine) and 539 (serine) and/or between 565 (arginine) and 566 (histidine), and/or between 646 (arginine) and 647 (glutamic), and/or between 656 (arginine) and 657 (proline) and/or between 848 (arginine) and 849 (lysine) of hsulf-2. Cleavage is necessary for activity of the enzyme.

Following the first "sulfatase domain" are hydrophilic domains containing a high concentration of charged amino acids which are predominantly basic in nature. These domains are comprised of about 370 amino acids.

Immediately following the sulfatase domain of the Sulfs is a hydrophilic region of 300-320 amino acids, containing a high content of charged amino acids, ≈27% of which are basic and ≈13% are acidic. At the C-terminus of each of the newly cloned Sulfs is a region of 108 residues, which shows significant homology to the C-terminal region of human lysosomal glucosamine-6-sulfatase (HG6S). In this region, there is complete conservation of 30 of 108 residues between HG6S and the two human Sulfs. Interestingly, this region also bears significant homology to a GlcNAc transferase from *Arabidopsis thaliana* (AAL60196). Over a 74 amino acid segment (626-699) of this plant protein, 8 of the aforementioned 30 amino acids are conserved. These comparisons suggest that the C-terminal regions of the Sulfs and the lysosomal G6S may be involved in recognition of glucosamine/GlcNAc components of substrates. This domain is referred to as the "G6S-related domain."

Inspection of the sequences reveals additional features that are shared by the mammalian Sulfs. Each protein exhibits a predicted coiled-coil structural unit of 34-35 residues. This feature is found in a corresponding position within the hydrophilic region of each protein (Table 2). Short coiled-coils serve as multimerization elements for a large number of both intracellular and extracellular proteins. The Sulf sequences also contain several consensus cleavage sites for furin, a trans-Golgi network endoprotease. These sites, which are mostly found in the hydrophilic regions, are highly conserved between the mouse and human orthologs of Sulf-1 and Sulf-2. As demonstrated below, processing of the secreted forms of the mammalian Sulfs appears to involve furin-mediated cleavage events.

TABLE 2

Features of the Sulf (sulfatase) proteins

| Feature | HSulf-1 | MSulf-1 | HSulf-2 | MSulf-2 |
|---|---|---|---|---|
| Length (aa) | 871 | 870 | 870 | 875 |
| No. N-linked sites | 10 | 10 | 11 | 11 |
| Signal sequence* | 1-22 | 1-27 | 1-24 | 1-24 |
| Sulfatase domain# | 42-414 | 42-414 | 43-415 | 43-415 |
| Hydrophilic region | 415-735 | 415-734 | 416-715 | 416-721 |
| G6S-related region | 736-843 | 735-842 | 717-824 | 722-829 |
| Coiled-coil** | 639-673 | 638-672 | 623-658 | 629-663 |
| Furin cleavage sites | 408-409 | 408-409 | 409-410 | 409-410 |
|  | 576-577 | 575-576 | 423-424 | 423-424 |
|  | 661-662 | 660-661 | 538-539 | 543-544 |
|  | 669-670 |  | 565-566 |  |
|  | 732-733 | 731-732 | 646-647 | 651-652 |
|  |  |  | 656-657 | 661-662 |
|  |  |  | 848-849 | 853-854 |

FIG. 14 presents a model of activity of a subject sulfatase. Subject sulfatases are extracellular enzymes that remove sulfate from the C-6 position of glucosamine (GlCN) or N-Acetyl glucosamine (GlcNAc) within heparan sulfate proteoglycans on the cell surface or in the extracellular matrix. The sulfatase releases growth factors/differentiation factors/angiogenic factors. An example of such a factor is vascular endothelial growth factor (VEGF). Release of VEGF makes it available to endothelial cells (EC), converting a quiescent (e.g., non-angiogeric) EC to a proliferating (e.g., angiogenic) EC.

Example 7

Expression of Hsulf-1 and Hsulf-2 in CHO Cells

Methods

Human sulf-1 (hsulf-1), hsulf-2 cDNA, mouse sulf-1 (msulf-1), and msulf-2 cDNAs were digested with XhoI and BamHI, HindIII and XhoI, NheI and HindIII, or HindIII and XhoI restriction enzymes, respectively and subcloned into the corresponding sites of pcDNA3.1/Myc-His(−) (Invitrogen Inc.). This 5.5 kb vector is designed for overproduction of recombinant proteins with a C-terminal tags consisting of a polyhistidine metal-binding tag and the myc epitope. Chinese hamster ovary cells (CHO) were grown in 10 cm dishes and transfected with 5 μg of pcDNA3.1/Myc-His(−)-hsulf-1, -hsulf-2, -msulf-1, or -msulf-2 using Lipofectamine and Plus reagent (Invitrogen Inc.) according to the manufacturer's instructions. DNA was mixed with Plus reagent and incubated for 15 minutes at room temperature.

The complexed DNA was combined with Lipofectamine reagent (diluted in OptiMEM (GIBCO BRL)) and incubated for 15 minutes at room temperature. The complexes were added to cells in culture dishes, and incubated at 37° C. at 5% $CO_2$ for 5 hours. After incubation, medium was replaced with OptiMEM. Cells were allowed to grow for an additional 48 hours, and the conditioned medium was collected. The samples were concentrated on a Centricon30 microconcentrator (Amicon), separated by electrophoresis on reducing SDS-8% polyacrylamide gels (ISC BioExpress), blotted to ProBlott™ (Applied Biosystems). The membranes were blocked for 1 hour with 5% non-fat milk and then incubated overnight with a 0.22 μg/ml dilution of anti-Myc antibody (Invitrogen) in 5% non-fat milk. Membranes were washed and incubated with horseradish peroxidase goat anti mouse IgG1 (0.4 μg/ml dilution) (Caltag) for 1 hour before enhanced chemiluminescence (ECL) detection reagents (Amersham Pharmacia).

Results

The 4 sulfatase fusion proteins were detected as a series of bands as follows (hsulf-1: 126, 61, 53 kDa) (hsulf-2: 126, 61 kDa), (msulf-1: 126, 61, 49, 40 kDa) and (msulf-2: 126, 71, 66 kDa).

Expression and Proteolytic Processing of Sulf Proteins in Cho Cells

Sulf-1 and Sulf-2 cDNAs (mouse and human) were subcloned into the pcDNA3.1/Myc-His expression vector in order to generate recombinant proteins with a tandem arrangement of a His and a Myc tags at their C-termini. Initially, we transfected COS-7 with cDNAs for Sulf-1 and Sulf-2 (mouse and human). Taking advantage of the Myc tag for Western blotting, we detected a 132 kDa band for each Sulf in detergent lysates of the transfected cells but failed to observe reactivity in the conditioned medium of these cells. We also detected expression of the tagged proteins on the cell surface of transfected COS cells by immunofluorescence. These results parallel the findings with respect to QSulf-1 and RSulfFP1. However, when we used CHO cells for transfection, analysis of conditioned media by Western blotting (anti-Myc antibodies) revealed a series of bands. The results observed for HSulf-1 and HSulf-2 are very similar to those observed for the mouse orthologs. In each case, the highest molecular weight species had an apparent molecular weight of 132 kDa. Based on primary amino acid sequence, the calculated molecular weights of the tagged Sulf proteins were 100 kDa after cleavage of the signal sequences. The extra mass is attributable to N-glycosylation, since N-glycanase treatment of either HSulf-1 or HSulf-2 reduced the molecular weight of the 132 kDa species to ≈100 kDa. Interestingly, HG6S is also substantially glycosylated with 13 potential N-linked sites of which at least 10 are used.

Example 8

Verification of the Sulfatase Activities of the Sulf Proteins

Methods

Arylsulfatase Activity Assay

The 100-fold concentrated conditioned medium (CM) derived from each transfection of CHO cells as described above was dialyzed into 50 mM HEPES, pH 8.0. The His-tagged fusion proteins were bound to a Ni-NTA resin (QIAGEN) by rotation at 4° C. over night, then washed with 50 mM HEPES (pH 8.0), 3 times. 250 mM imidazole in 50 mM HEPES, pH 8.0 was used to elute the His-tagged fusion proteins from Ni-NTA. The resins with boud material or the eluates were mixed with 10 mM 4-methylumbelliferyl-sulfate (4-MUS; a substrate for sulfatases), and 10 mM lead acetate, in a total volume of 100 µl. The reaction mixtures were incubated at 37° C. for various periods of time. Reactions were terminated by the addition of 100 µl of 0.5 M $Na_2CO_3/NaHCO_3$, pH 10.7 to 20 µl of the reaction mixture. The fluorescence of 4-methylumbelliferone was measured on a Multi-Well Plate Reader CytoFluorII (PerSeptive Biosystems). The fluorescence was determined at an excitation wavelength of 360 nm and emission wavelength of 460 nm. A substrate dose response curve was performed over the concentration range of 1 to 10 mM 4-MUS. $V_{max}$ values were approximated from these data, employing the estimate of the Sulf protein concentrations in the CM.

Results

Time-dependent sulfatase activity was detected for both the hsulf- and hsulf-2 fusion proteins. The activity varied with the concentration of enzyme added, as demonstrated for hsulf-1. These results demonstrated unequivocally that the subject proteins possess sulfatase activity.

Arylsulfatase Activity of Expressed Proteins

The synthetic fluorogenic compound 4-methylumbelliferyl sulfate (4-MUS) serves as a substrate for most sulfatases, both in the lysosomal and non-lysosomal classes. CHO cells were transfected with a cDNA for HSulf-1 or HSulf-2 or a vector control. Conditioned medium was collected and incubated with nickel resin (Ni-NTA) to bind the His-tagged recombinant proteins. The bead-bound material was assayed for activity on 4-MUS. For both enzymes, hydrolysis depended on time of reaction (FIG. 15A), concentration of substrate (FIG. 15B), and amount of CM (FIG. 15C). From the substrate dose-response curves of FIG. 15B and based on estimates of Sulf protein levels in CM, we approximated $V_{max}$ for the two Sulfs to be in the range of 1000-2000 nmol per min per mg of Sulf protein. Human glucosamine-6-sulfatase has a considerably lower $V_{max}$ against 4-MUS (100 mmol per min per mg) whereas the $V_{max}$ of human N-acetylgalactosamine-4-sulfatase (arylsulfatase B) is much higher (48000).

As described above, a conserved cysteine in the sulfatase domain of eukaryotic sulfatases is essential for their catalytic activities. We mutated the corresponding residues in Sulf-1 (Cys87) and Sulf-2 (Cys88) and the adjacent cysteines to alanines. While the levels of the mutant proteins in CM were equivalent to those of the wild-type, arylsulfatase activity was completely lost for both proteins (FIG. 15C).

FIGS. 15A-D. Arylsulfatase activity of expressed Sulfs and Lack of the activity in HSulf mutants. HSulf-1, HSulf-2 or their mutated forms (HSulf-1 ΔCC and HSulf-2 ΔCC) was purified from the conditioned medium of transfected CHO cells by binding to Ni-NTA beads. A) The bead-bound material was tested for arylsulfatase activity as a function of time against 10 mM 4-MUS substrate at pH 8. The "no-enzyme" control was based on testing conditioned medium from vector-control transfected CHO cells. No activity was detected in the absence of added substrate (not shown). The same results were obtained in 3 different experiments. B) The concentrated conditioned medium was tested for arylsulfatase activity at pH 8 for 2 hr at different concentrations (1-10 mM) of 4-MUS. To eliminate background effects, the activity in vector control material was subtracted from that of Sulf transfected material. C) The eluted material from Ni-NTA was tested for arylsulfatase activity at pH 8 for 2 hr as a function of input volume of conditioned medium. The same results were obtained in 3 different experiments. D) Bead-bound Sulfs were tested for arylsulfatase activity (1 hr) at the indicated pH values. The activity of each Sulf was determined relative to that of beads exposed to an equivalent volume of vector-control conditioned medium. The activity of HG6S was determined (24 hr incubation) relative to that of the buffer. The same results were obtained in 3 different experiments.

Example 9

Endosulfatase Activity and pH Dependency

Methods

Determination of pH Dependency of Sulfatase Activity

To determine the pH dependency of the activity of sulfatase, His-tagged fusion proteins bound to Ni-NTA resin were washed with $H_2O$ three times and mixed with 10 mM 4-MUS, 10 mM lead acetate and 50 mM HEPES (pH 8.0 or pH 7.0) or 50 mM sodium acetate buffer (pH 5.0 or pH 6.0). Human glucosamine-6-sulfatase was purchased from Glyko Inc. (Novato, Calif.) and was tested at a concentration of 1 milliunit.

In order to block the potential N-formylglycine modification of Cys 87 of HSulf-1 and Cys88 of HSulf-2, cysteines 87 and 88 of HSulf-1 (designated as HSulf-1 ΔCC) and cysteines 88 and 89 of HSulf-2 (designated as HSulf-2 ΔCC) were mutated to alanines using the QuikChange™ XL Site-Directed Mutagenesis kit (Stratagene, La Jolla, Calif.) according to the manufacturer's instructions.

Endo-Glucosamine-6-Sulfatase Assays of the Sulfatases

The procedures of Yoshida et al ((1989) *Anal. Biochem.* 177:327-332) were adapted for these assays. CM from transfected CHO cells (wild-type Sulfs, vector control or the double cysteine mutants) was prepared as described above. The standard reaction mixture contained 5 µmol of Tris-HCl, pH 7.5, 1 µmol of $MgCl_2$, 10 µg of porcine intestinal heparin (Sigma, St. Louis, Mo.) and 20 µl of the 100-fold concentrated CM in a total volume of 100 µl. After incubation at 37° C. for 8 hr, the reaction was stopped by heating at 100° C. for 2 min. A mixture of 1 milliunit of Heparinase I (EC 4.2.2.7, Sigma), 0.25 milliunits of Heparinase II (Sigma) and 0.1 milliunits of Heparinase III (EC 4.2.2.8, Sigma) in 1.5 µl of 50 mM Tris-HCl, pH 7.5, was added to the reaction mixture and incubated at 37° C. for 3 hr. The digestion was stopped by heating at 100° C. for 2 min, and the mixture was filtered by centrifugation in an Ultrafree-MC filter (Millipore).

The disaccharides of the digested heparin were then analyzed by HPLC on a Partisil-10 SAX column (Whatman, Fairfield, N.J.) run at 41° C. Disaccharides were eluted from the column by increasing the ionic strength as follows: time 0-5 min, 12 mM $KH_2PO_4$; time 5-40 minutes, gradient from 12 mM to 600 mM; time 40-45 min, 600 mM. Absorbance at 232 nm was monitored and components were identified by comparison with authentic unsaturated disaccharide markers from Sigma, i.e. ΔDiHS-0S, ΔDiHS-6S, ΔDiHS-NS, ΔDiHS-(N,6)diS, ΔDiHS-(N,2)diS and ΔDiHS-(N,6,2)triS. The endo-glucosanine-6-sulfatase activities of human Sulf-1 and Sulf-2 against heparin proceeded linearly up to 10 hr under these conditions. In other assays, 10 µg of chondroitin 6-sulfate was employed as a substrate in the standard assay. After incubation with CM, 15 milliunits of Chondroitinase ABC (EC 4.2.2.4, Sigma) was used to fragment the chondroitin sulfate. The standards used were as follows: ΔDi-0S, ΔDi-6S, ΔDi-4S, ΔDi-diSD(2,6) and ΔDi-diSE(4,6). All were from Oxford GlycoSystems Inc.

Results
pH Dependency of Sulfatase Activity

As demonstrated in FIG. 15D, maximal activity of the sulfatase was observed at pHs of 7 and 8. In contrast, the lysosomal enzyme, HG6S, assayed under the same conditions, showed measurable activity at pH 5 but none at pH 8, consistent with the acidic milieu of the lysosome. This finding dictated the use of neutral pH's (7.5-8) for the other assays (FIGS. 15A-15C) and for the endosulfatase experiments described below.

Endo-Glucosamine-6-Sulfatase Activity of Expressed Proteins.

The Sulfs (sulfatases) are active on heparin/heparan sulfate. Indeed, the sulfatases described above are endosulfatases, in contradistinction to glucosamine-6-sulfatase, which like other lysosomal sulfatases, is an exosulfatase.

Figure 16:
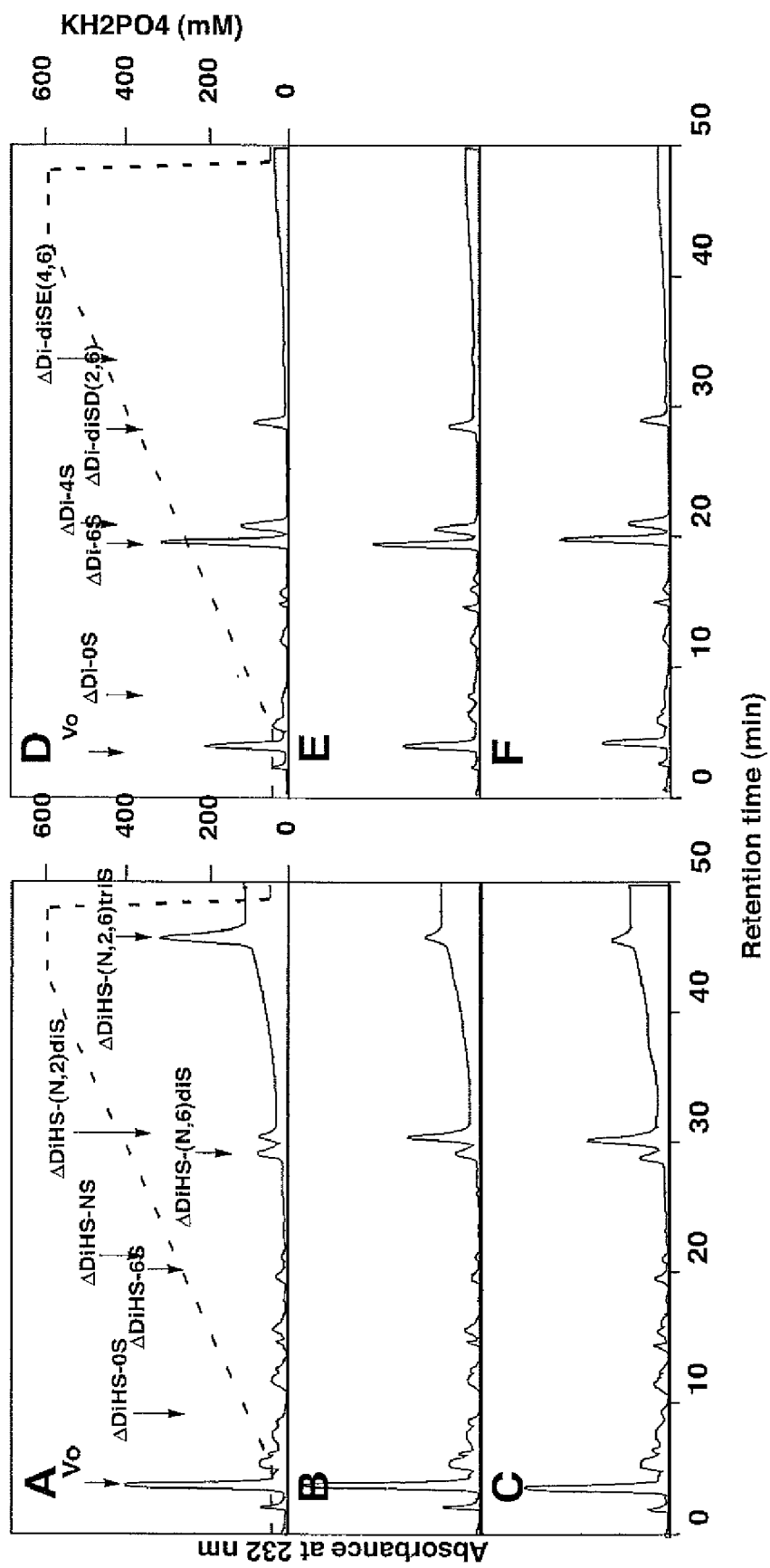

Intact heparin (10 µg) was treated with conditioned medium from Sulf transfected CHO cells. To analyze activity on specific sulfation modifications, we digested the treated heparin with a mixture of bacterial heparinases and analyzed the disaccharide products by HPLC using standards (Yoshida, supra). Both HSulf-1 CM and Hsulf-2 CM produced an ≈80% reduction in the amount of trisulfated units (ΔDiHS-(7,6,2)triS) corresponding to IdoA2S-GlcNS6S and a parallel increase in that of disulfated units (ΔDiHS-(N,2)diS) corresponding to IdoA2S-GlcNS (FIG. 16A-C). There were no effects on the disulfated units ΔDiHS-(N,6)diS, monosulfated or non-sulfated units. Specific activities were calculated based on the volume of CM (Table 3). The endosulfatase activities of Sulf-1 and Sulf-2 CM were increased 9-fold and 10-fold respectively relative to CM from mock transfected cells (Table 3). Mutation of the critical cysteines within the two Sulfs resulted in the complete loss of these activities (Table 3). Further selectivity of the endosulfatase activity was indicated when we employed chondroitin 6-sulfate as a substrate. As shown in FIG. 16D-F, N-acetylgalactosamine 6-sulfate residues in chondroitin 6-sulfate did not serve as substrates for the Sulfs. Thus the Sulfs are active against intact heparin. Treatment of intact heparin at neutral pH with either HSulf-1 or HSulf-2 resulted in 80% removal of sulfate from the 6-position of glucosamine within the trisulfated trisaccharides; however, there was no effect on GlcNS6S within disaccharide units when the neighboring IdoA lacked 2-0 sulfation. These results establish that the Sulfs are endosulfatases with high selectivity for glucosamine 6-sulfate in the appropriate context within heparin and heparan sulfate.

FIGS. 16A-F. The conditioned medium of CHO cells transfected with the empty vector alone (A, D), HSulf-1 (B, E) or HSulf-2 (C, F) was prepared as described above. Porcine intestinal heparin (A-C) or shark cartilage chondroitin 6-sulfate (D-F) were incubated with the conditioned medium and then subsequently digested with either a mixture of bacterial heparinases or chondroitinase ABC. The resulting disaccharide fractions were analyzed by as described. The arrows correspond to the elution positions of authentic unsaturated disaccharide markers. The dotted lines indicate the concentrations of $KH_2PO_4$ used for elution.

TABLE 3

Endo-glucosamine-6-sulfatase activity of the Sulfs

| Plasmid | Endo-glucosamine-6-sulfatase activity (pmol/hr/ml of medium) |
|---|---|
| Mock | 9.4 ± 0.2 |
| HSulf-1 | 87.8 ± 0.1 |
| HSulf-1 ΔCC | 7.7 ± 1.2 |
| HSulf-2 | 96.6 ± 0.5 |
| HSulf-2 ΔCC | 5.6 ± 0.6 |

Endo-glucosamine-6-sulfatase activity was measured against intact heparin as described in above using CM derived from CHO cells transfected with the indicated vectors. HSulf-1 ΔCC and HSulf-2 ΔCC denote the CC87, 88AA and CC88, 89AA mutants, respectively. Endosulfatase activity was defined by calculating the moles of unsaturated trisulfated disaccharides from which the sulfate group on C-6 position was liberated in the standard assay (FIGS. 16A-F) by the Sulfs as compared to levels in untreated control samples. Values shown are means±S.D. based on three independent reactions.

Example 10

Expression of Sulf Genes in Human Breast Cancer Tissues

Methods

The Rapid-Scan Gene Expression Panel (Origene Inc.) is a set of cDNAs prepared from 12 independent normal breast tissues (human) and 12 independent breast cancer patients. A 314-bp hsulf-2 cDNA product was amplified using the following PCR primers: sense 5'-GAAAAGAGGCAGAT-TCACGTCGTTTCCAG-3' (SEQ ID NO:25), antisense 5'-ATCTGGTGCTTCTTTTGGGATGCGGGAG-3' (SEQ ID NO:26). The conditions for denaturation, annealing, and extension of the template cDNA were respectively: 94° C. for 30 seconds, 55° C. for 30 seconds, 72° C. for 1 minute for 40 cycles. For each source of cDNA, PCR was performed at 4 different cDNA concentrations (1×, 10×, 100× and 1000×) using TITANIUM™ Taq DNA Polymerase (Clontech). The PCR products were then electrophoresed on 2% agarose gels, and visualized with ethidium bromide.

Results

Nine of 12 of the breast cancer specimens were positive for hsulf-2 expression whereas none (0 of 12) of the normal breast tissue samples were positive at any cDNA concentration. The results are shown in Table 4, below. The level of expression of estrogen receptor (ER) and progesterone receptor (PR) on breast cancer tissues is also shown.

TABLE 4

| lane | Tissue | Grade | characteristics | Expression of hsulf-2 |
|---|---|---|---|---|
| 1 | Normal breast | | | − |
| 2 | Normal breast | | | − |
| 3 | Normal breast | | | − |
| 4 | Normal breast | | | − |
| 5 | Normal breast | | | − |
| 6 | Normal breast | | | − |
| 7 | Normal breast | | | − |
| 8 | Normal breast | | | − |
| 9 | Normal breast | | | − |
| 10 | Normal breast | | | − |
| 11 | Normal breast | | | − |
| 12 | Normal breast | | | − |

TABLE 4-continued

| lane | Tissue | Grade | characteristics | Expression of hsulf-2 |
|---|---|---|---|---|
| 13 | Invasive mixed tubular carcinoma | 5 | ER+ PR+++ | − |
| 14 | Invasive ductal carcinoma | 9 | ER+ PR+++ | − |
| 15 | Invasive lobular carcinoma | 6 | ER++++++ PR+++++ | + |
| 16 | Invasive ductal carcinoma | 7 | ER++ PR− | − |
| 17 | Invasive ductal carcinoma | ? | ER++ PR− | + |
| 18 | Invasive ductal carcinoma | 6 | ER+++ PR+ | + |
| 19 | Invasive ductal carcinoma | 5 | ER++ PR+ | + |
| 20 | Invasive ductal carcinoma | 6 | ER+ PR− | + |
| 21 | Adenoid cystic carcinoma | — | ER++ PR+ | + |
| 22 | Invasive ductal carcinoma | 5 | ER− PR− | + |
| 23 | Ductal carcinoma in-situ | — | ER+ PR+/− | + |
| 24 | Invasive ductal carcinoma | 8 | ER+ PR+ | + |

Example 11

Pro-Angiogenic Activity of Hsulf-2

Sulf-2 functions as a heparan sulfate degrading enzyme (HSDE) during tumor angiogenesis by mobilizing angiogenic factors from sequestration with HSPGs We employed the chick chorioallantoic membrane (CAM) assay, a standard angiogenesis assay. CHO cells were stably transfected with HSulf-1, HSulf-2, or the empty vector and clones were isolated. Single clones of each type were implanted on the surface of the CAM of 9 day embryos. After 72 hrs, the number of new blood vessel branches was determined under a dissecting scope. As shown in FIG. 17, the CHO-Sulf-2 clone induced a dramatic response as compared to the CHO-Sulf-1 clone or the empty vector clone.

FIG. 17. Pro-angiogenic activity of HSulf-2. $5 \times 10^6$ CHO cells were implanted on the CAM of 9-day chick embryos. The CHO cells were clones that were stably transfected with either the empty vector (clone V1), HSulf-1 (clone 9) or HSulf-2 (clone 18). After 72 hrs of further incubation, the number of blood vessel branches was counted under a dissecting microscope. 6 eggs were treated with each type of CHO cell. Means and standard errors of the means are indicated.

Example 12

Human Extracellular Sulfatases are Upregulated in Pancreatic Cancer and Regulate Cell Proliferation and Wnt Signaling Experimental Procedures Constructs HSulf cDNA constructs were cloned as described. Morimoto-Tomita et al. (2002) *J Biol Chem* 277:49175-49185. For the HSulf antisense construct, pcDNA3.1-HSulf-2-myc-his was digested with XhoI/HindIII and cloned it in the Vector pcDNA3.1 (+) using the same enzymatic sites. For conditional HSulf-2 siRNA experiments, the target region GCTGCATAAGTGC (SEQ ID NO:27) was used and was cloned into the plasmid pSico as described. Ventura et al. (2004) *Proc Natl Acad Sci U S A* 101:10380-10385. The pPGK-cre-bpa plasmid was generously provided by Dr. M. S. German.

Immunoblot and Immunohistochemistry

Cell lysates were prepared rinsing cells twice with D-PBS following extraction in RIPA buffer (150 mMNaCl, 1% Triton, 0.05% SDS, protease inhibitor cocktail (Roche), 50 mM Tris-HCl pH 7.5) for 20 minutes on ice. Insoluble material was pelleted by centrifugation for 30 minutes at 20,800 g. For analysis of conditioned medium (CM), the CM was concentrated on a Centricon30 microconcentrator (Millipore Corp.). Total cell lysates or CM were subjected to 10%, polyacrylamid gels (BioRad) separated by SDS-PAGE and blotted to ProBlott™ (Applied Biosystems). Protein detection was performed as described (Morimoto-Tomita et al. (2002) supra) with affinity purified rabbit polyclonal antibodies H1.5 for HSulf-1 or H2.3 for HSulf-2.

For immunohistochemical analyses frozen sections (10 μm) were fixed for 10 minutes in cold acetone. Following blocking (5% goat serum, 3% BSA in PBS) for 30 minutes sections were incubated with the first antibody (H1.5, 1 μg/ml) for 1 hour. After washing in PBS, a secondary biotinylated goat anti rabbit (Jackson Immunoresearches Laboratories) was added and fluorescence was developed with Cy2-conjugated streptavidin (Jackson Immunoresearches Laboratories).

Cell Culture and Gene Transduction

Human pancreatic adenocarcinoma cell lines CFPAC-1, HS766T, L3.6sl and the human embryonic kidney cells HEK 293 were maintained in Dulbecco's modified Eagle's (DMEM) medium supplemented with 10% fetal bovine serum. The human pancreatic adenocarcinoma cell line BxPC-3 was maintained in RPMI medium supplemented with 10% fetal bovine serum. For transient transfections, Fugene (Roche) was used according to the manufacturer's protocol or for Cre transfection we used the Basic Nucleofector Kit for Primary Mammalian Epithelial Cells (amaxa) following the manufacturer's protocol. Lentivirus infection was performed as described. Ventura et al. (2004) supra. 15-20 GFP positive colonies were picked and cultured together. 10 days after Cre-transfection cell populations were sorted by FACS cytometry for GFP negative cells.

RT-PCR

Total RNAs were extracted using Trizol (Invitrogen) and were reversed transcribed using the superscript II Reverse Transcriptase (Invitrogen). Primers used were for HSulf-1 forward: 5'-CTCACAGTCCGGCAGAGCACGCGGAAC-3' (SEQ ID NO:53), and reverse: 5'-CACGGCGTTGCTGC-TATCTGCCAGCATCC-3' (SEQ ID NO:54). For HSulf-2, the primers used were: forward 5'-GAAAAGAGGCAGAT-TCACGTCGTTTCCAG-3' (SEQ ID NO:25) and reverse 5'-ATCTGGTGCTTCTTTTGGGATGCGGGAG-3'(SEQ ID NO:26).

Luciferase Reporter Assays

Cells were plated in 24 well plates and transfected with either 0.3 μg TOPFlash or FOPFlash and 0.01 μg *Renilla* control plasmid (Promega) using Fugene (Roche) according to the manufacturer's procedure. After 48 hours cells were lysed and analyzed utilizing the Dual Luciferase Reporter Assay system (Promega). Luciferase activity was normalized to control *Renilla* activity.

To assay HSulf influence on Wnt signaling in HEK 293 cells, HEK 293 cells were transfected with TOP/FOPFlash and *Renilla* control plasmid. 24 hours later the medium was changed, and Wnt1-transfected 3T3 human fibroblasts were added. 24 hours later, Luciferase activity was measured, as described above.

Co-Culture Experiment

Co-culture experiments were performed in transwell plates with 24-well inserts with 5 μm polycarbonate membrane pore size (Corning Incorporated). HEK 293 cells were plated in the wells as feeder layer and one day later $1-2\times10^3$ cells of the pancreatic adenocarcinoma cell lines were plated in the inserts. Cells were grown in DMEM supplemented with 10% fetal calf serum.

BrdU Incorporation Assay

BrdU incorporation was measured using the FITC BrdU Flow Kit (BD Biosciences) and followed the manufacturer's protocol, pulsing cells with 10 μM BrdU for one hour. Cells in S-Phase were defined as BrdU positive cells.

Results

HSulf-1 and HSulf-2 are Upregulated in Human Pancreatic Cancer.

To examine the expression of HSulfs in pancreatic cancer we surveyed a panel of 24 different pancreatic adenocarcinoma cell lines was surveyed; and RT-PCR was performed against both HSulfs (FIG. 18A). HSulf-1 transcripts were detected in 15 and HSulf-2 transcripts in 23 of these cell lines. To confirm these results on protein level, four cell lines were chosen, which were positive for both HSulf transcripts and performed western blots with lysates and conditioned medium against both sulfatases (FIG. 18B). Both HSulf-1 and HSulf-2 protein was detected in all four cell lines. Only HSulf-2 protein was released into the conditioned medium indicating that endogenous HSulf-1, although lacking a transmembrane domain, is recruited to the detergent soluble fraction of cells, whereas endogenous HSulf-2 can be found in both the cellular fraction and in medium.

Expression of HSulf-1 protein was analyzed in normal pancreatic tissue from two different patients and 5 different pancreatic cancer tissue specimens. Using the antibodies H1.5 against Sulf-1, positive staining was detected for HSulf-1 in three out of the five cancer specimens. HSulf-1 was detected primarily in tubular complexes but also in the infiltrating cancer cells themselves whereas tissue from normal pancreas showed staining only in very few single cells within the acini. There is no evidence to date that the HSulf-2 antibody detects HSulf-2 protein in histology of human tissue. In summary, it was demonstrate that HSulf-1 is strongly upregulated in human pancreatic cancer tissue and human pancreatic adenocarcinoma cell lines and that HSulf-2 is expressed in 95% of 24 examined pancreatic adenocarcinoma cell lines.

HSulf-1 but not HSulf-2 is a Target Gene for Hedgehog.

Active sonic Hh signaling has been shown to be important for aberrant proliferation and tumorigenesis in pancreatic cancer. Berman et al. (2003) *Nature* 425:846-851; Thayer et al. (2003) *Nature* 425: 851-856. The quail orthologue of HSulf-1, QSulf-1, was originally described as a target gene for sonic Hh. Dhoot et al. (2001) *Science* 2931663-1666. The question if the human sulfatases HSulf-1 and HSulf-2 are also target genes of Rh signaling, and therefore are linked to aberrant Mh signaling during tumorigenesis in pancreas, was addressed. Human pancreatic ductal cells (Pdc), which show no differences to wild type pancreatic ductal cells, were used. Schreiber et al. (2004) *Gastroenterology* 127:250-260. To activate sonic M signaling Pdc cells were transfected transiently with a dominant active form of Gli2 that results in a constitutive activation of hedgehog target genes. Roessler et al. (2003) *Proc Natl Acad Sci USA* 100:13424-13429. Transcription of sulfatases was measured using semi-quantitative RT-PCR and SYBR-green real time PCR (FIG. 18C). HSulf-1 mRNA is upregulated in Pdc cells after transfection with dominant active Gli2, whereas HSulf-2 is not regulated via Gli2 in these cells (FIG. 18C). Thus, in pancreatic duct cells, HSulf-1 is a Hh target gene, indicating a possible link between aberrant Rh activity and HSulf-1 expression. Expression of HSulf-2 clearly is not influenced by Gli2, thus indicating that expression of the two known extracellular human sulfatases regulated via different signaling mechanisms.

HSulf-1 and HSulf-2 Positively Regulate Wnt Signaling Mammalian Cells.

Figure 19:
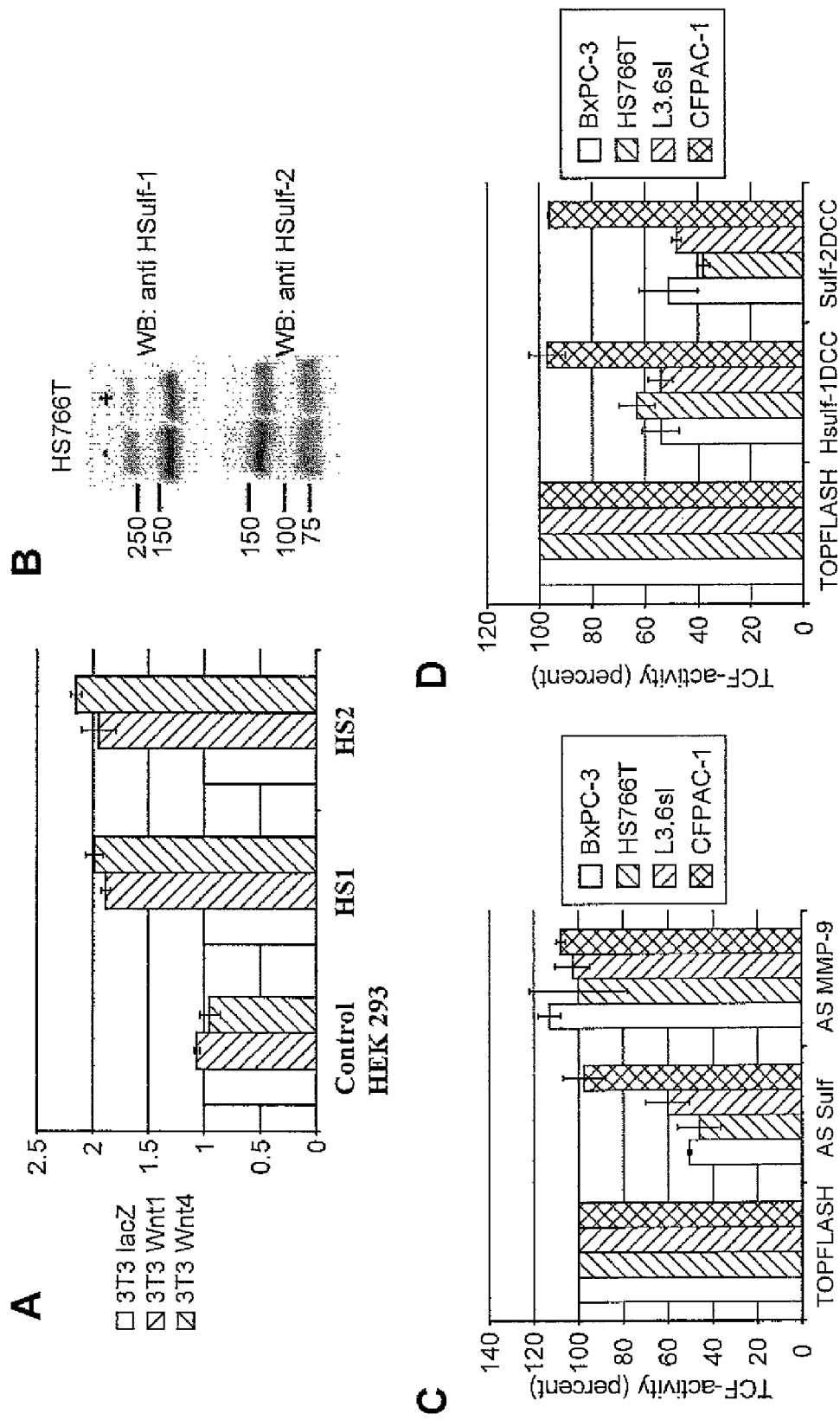

Wnt signaling has been shown to be enhanced by Qsulf-1, the quail orthologue of the human HSulfs. Dhoot et al. (2001) supra; Ai et al. (2003) *J Cell Biol* 162:341-351. In order to determine if the human Sulfs affect Wnt signaling, the effect of HSulf-1 and -2, when overexpressed in a heterologous expression system on Wnt signaling, was analyzed. For this purpose, HEK 293 cells stably transfected with either HSulf-1 (HS1) or HSulf-2 (HS2) were co-cultured with Wnt1 or Wnt4 expressing 3T3 fibroblasts. Wnt activity was measured by utilizing a quantitative TCF-luciferase reporter gene (FOPFlash/TOPFlash system). van de Wetering et al. (1997) *Cell* 88:789-799. Expression of both HSulfs increased Wnt activity two-fold, whereas mock-transfected HEK293 cells did not respond on co-culture with Wnt1 expressing fibroblasts (FIG. 19A).

To search for evidence that endogenous expressed sulfatases in pancreatic adenocarcinoma cell lines regulate Wnt signaling, the method of gene silencing was used. An antisense cDNA against both sulfatases was transiently transfected into four different cell lines. As a control, cells were transfected with a MMP-9 antisense cDNA. Wnt signaling was quantified by TCF-luciferase activity. Detection of HSulf protein levels by western blotting revealed an inhibition of both sulfatases by the antisense cDNA about 50% as shown for HS766T cells (FIG. 19B). Wnt signaling was inhibited about 50% in three of the four examined cell lines (FIG. 19C) whereas the control did not show any effects. Together, this result clearly indicates that the HSulfs can enhance Wnt signaling.

To independently confirm the role of endogenous HSulfs in Wnt signaling, the enhancing function of HSulfs on Wnt signaling was antagonized by expressing catalytic inactive human sulfatases. Catalytically inactive HSulf-1 (HSulf1-DCC) or HSulf-2 (HSulf2-DCC) cDNAs (Morimoto-Tomita et al. (2002) supra) were transfected into four different pancreatic adenocarcinoma cell lines and quantified Wnt activity. HSulf-1 DCC and HSulf-2 DCC mutants are as follows: 1) cysteines 87 and 88 of HSulf-1 (designated as HSulf-1 ΔCC or HSulf-1 DCC) were changed to alanines; and cysteines 88 and 89 of HSulf-2 (designated as HSulf-2 ΔCC or HSulf-2 DCC) were changed to alanines (see Example 9, above). Expression of either of these catalytic inactive sulfatase-encoding constructs inhibited Wnt activity about 50% in three of the four examined cell lines (FIG. 19D).

Together, these results define both human sulfatases as positive regulators of Wnt signaling in 75% of the examined pancreatic adenocarcinoma cell lines.

Exogenous Catalytic Inactive Human Sulf-2 Protein Inhibits Wnt Signaling and Cell Proliferation.

The canonical Wnt signaling pathway signals through an outside-in mechanism and one of its key functions is to induce cell proliferation. To further examine the effects of catalytic inactive HSulfs, the effect of exogenous inactive Sulf on Wnt signaling cell proliferation was assessed. For this purpose, HEK 293 cells, which were stably transfected either with human Sulf-2 (293 HSulf-2), or with the mutated catalytic inactivated HSulf-2 (293 HSulf-2DCC), or control cells, were used; Both the 293 HSulf-2 and 293 HSulf-2DCC secrete the recombinant protein into medium.

The effect of conditioned medium derived from the HEK 293 cell lines on Wnt signaling was determined. Pancreatic adenocarcinoma cells were incubated for 16 hours with conditioned medium derived from the described HEK 293 clones; and the TOP/FOPflash system was used to quantify Wnt signaling. Indeed, those cell lines that were inhibited in proliferation when cultured in medium conditioned for HSulf2-DCC but not HSulf-2 or the mock control showed a significant decrease in Wnt activity, whereas the CFPAC-1 cells did no respond in their Wnt activity (FIG. 20A).

To assess the effects of exogenous, catalytically inactive, Sulf-2 protein on cell proliferation, co-culture experiments were conducted in transwell chambers using the transfected HEK 293 cell lines as sources of exogenous HSulf-2. 293 cells expressing either HSulf-2, HSulf-2-DCC, parental 293 or only medium alone were used as feeder layer; and pancreatic adenocarcinoma lines were grown on transwell filters. Subsequently, cell counts were followed over time. As shown in FIG. 20B, proliferation was inhibited in BxPC-3, HS766T and L3.6sl cells only in the presence of the inactive HSulf2ΔCC protein but not in the presence of active HSulf-2, or control cells whereas CFPAC-1 cells did not show any response in this assay.

These results provide evidence that the presence of an exogenous catalytic inactive Sulf protein can inhibit proliferation and canonical Wnt signaling in pancreatic adenocarcinoma cell.

Silencing of HSulf-2 in Pancreatic Adenocarcinoma Cells Causes Decreased Proliferation.

Figure 21:
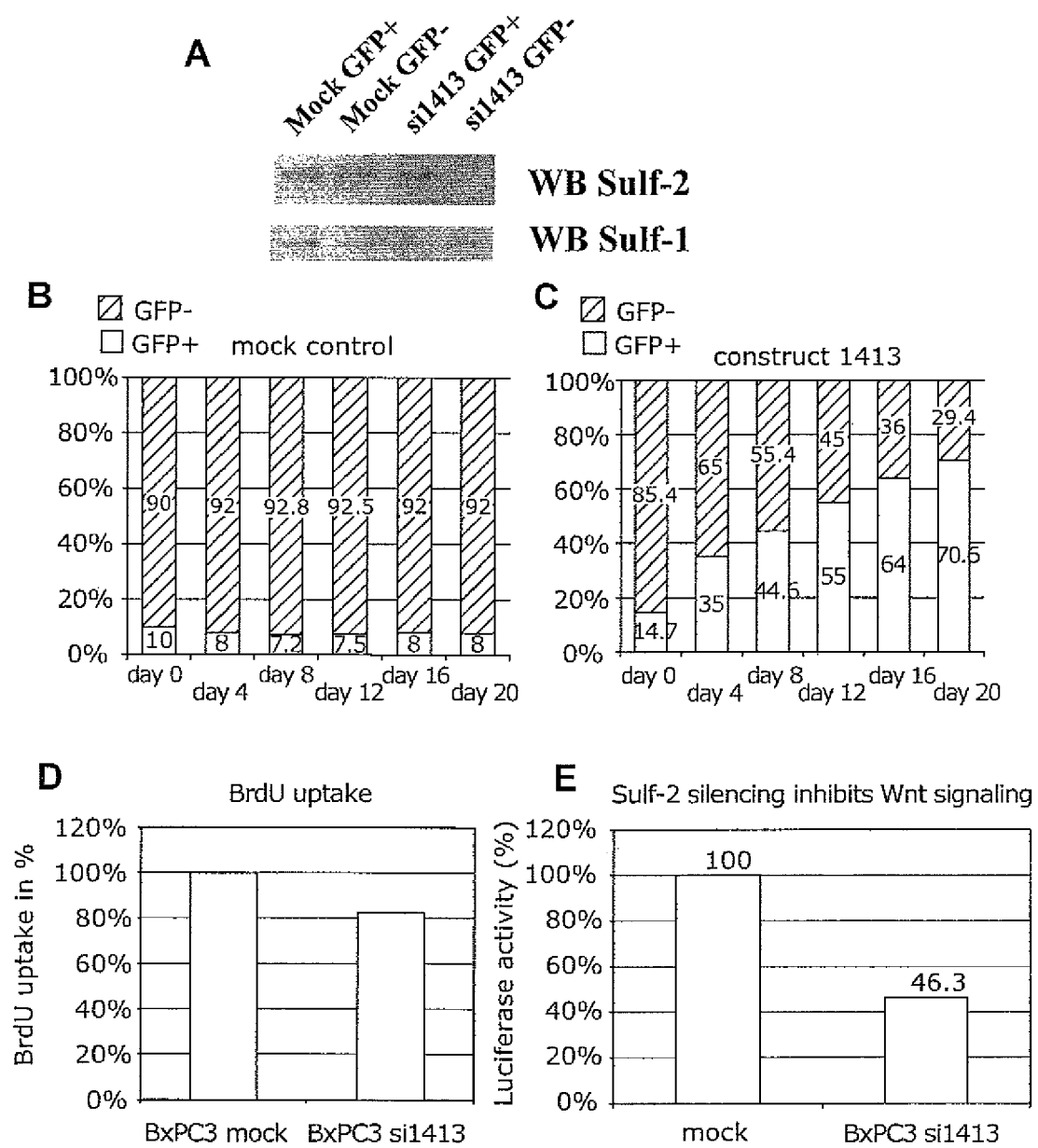

To further examine the role of HSulf-2 in Wnt signaling and proliferation siRNA technology was used to specifically silence endogenous HSulf-2 expression in BxPC-3 cells. This cell line predominantly expresses HSulf-2. A conditional, Cre-lox regulated system, in which a CMV-GFP reporter cassette is placed between an U6 promoter and the shRNA sequence, was used. Ventura et al. (2004) supra. The HSulf-2 target region 5'-GCTGCATAAGTGC-3' (SEQ ID NO:27) was cloned into the plasmid pSico as described. Ventura et al. (2004) supra. After lentivirus infection, GFP positive cells (BxPC sil413 GFP) were sorted by flow cytometry. For activating the shRNA, cells were transiently transfected with Cre-recombinase, which resulted in the excision of the CMV-GFP cassette and expression of the shRNA against HSulf-2 (BxPC3 sil413). As a control, an empty vector (B3xPC3 control) was used. By performing transient transfections, a mixed population of HSulf-2 positive (GFP positive) and HSulf-2 silenced (GFP negative) cells was generated. This population was subsequently sorted by flow cytometry for GFP negative cells. Western blot analysis of the Sulf-2 expression in these cell lines revealed that HSulf-2 expression is 90% silenced in BxPC3 sil413, whereas no silencing was observed in the control (FIG. 21A). Protein levels of HSulf-1 were not affected.

In order to compare proliferation of BxPC3 sil413 cells and mock transfected BxPC3 cells in vitro, GFP+ (HSulf-2 positive) and GFP− (HSulf-2 negative) cells were co-cultured; and the ratio of GFP+ to GFP− cells was followed over time. While the control did not show any change in the ratio of GFP+ and GFP− cells, the population of GFP− (HSulf-2 silenced) cells was reduced by 66% after 19 days (FIGS. 21B and 21C). This result indicates that Hsulf-2 silenced cells have a disadvantage in proliferation when co-cultured with control cells. Additionally, using sorted BxPC3 sil1413 cells we examined proliferation performing BrdU incorporation experiments (FIG. 21D). Compared to the control, HSulf-2 silenced cells showed 18% reduced BrdU uptake. Together, these results indicate a significant reduction of cell proliferation in HSulf-2 silenced cells. In addition, quantification of Wnt signaling by TCF-luciferase activity revealed inhibition of Wnt activity by 56% in HSulf-2 silenced cells compared to control cells (FIG. 21D).

These results clearly indicate that silencing of HSulf-2 in BxPC-3 cells leads to a significant decrease Wnt signaling and cell proliferation.

It is evident from the data presented above that the instant invention provides sulfatases that are glucosamine-6-sulfatase enzymes with activity against heparan sulfate glycosaminoglycans and related glycoconjugates. The enzymes are endosulfatases, capable of remove sulfate from internal glucamine-6-sulfate or N-acetylglucosamine-6-sulfate residues within glycosaminoglycans of heparan sulfate proteoglycans or from intact heparin The instant sulfatases are secreted from eukaryotic cells, and are expressed at higher than normal levels in cancerous tissue, compared to normal tissue. The instant invention also provides methods of assaying for sulfatase activity, which assay is readily adapted to a high throughput format. The enzymes are active at neutral pH, and so are specialized to function on the outside of cells.

While the present invention has been described with reference to the specific embodiments thereof, it should be understood by those skilled in the art that various changes may be made and equivalents may be substituted without departing from the true spirit and scope of the invention. In addition, many modifications may be made to adapt a particular situation, material, composition of matter, process, process step or steps, to the objective, spirit and scope of the present invention. All such modifications are intended to be within the scope of the claims appended hereto.

SEQUENCE LISTING (54 sequences)

SEQ ID NO: 1 - DNA, 5244 bp, Homo sapiens
ccacccaccatcatctaaagaagataaacttggcgaatgacatgcaggttcttcaaggcagaataattgcagaaaatcttcaaaggaccctatctgcagatgttctgaatacctctgagaatagagattgattattcaaccaggatacctaattcaaggactccagaaatcaggagacggagacattttgtcagttttgcaacattggaccaaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacctgggatctttctgtgcttgcacgagttctaacaataacacctactggtgtttgcgtacagttaatgagacgcataattttcttttctgtgagtttgctactggctttttggagtattttgatatgaatacagatccttatcagctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatgaagattgcctgctctctctgtgcctagcctcaaagcgttcatcatacatcatacctttaagattgctatattttgggttattttcttgacaggagaaaaagatctaaagatcttttattttcatcttttttggttttcttggcatgactaagaagcttaaatgttgataaaatatgactagttttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaacatatttatgatcatgaataatgtgctttgtaaaaagatttcaagttattaggaagcatactctgttttttaatcatgtataatattccatgatacttttatagaacaattctggcttcaggaaagtctagaagcaatatttcttcaaataaaaggtgtttaaactttaaaaaaaaaaaaaaaaaaaaaaaaaaaaaaaa

SEQ ID NO: 2 - DNA, 2616 bp, Homo sapiens
atgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacctgggatctttctgtgcttgcacgagttctaacaataacacctactggtgtttgcgtacagttaatgagacgcataattttcttttctgtgagtttgctactggctttttggagtattttgatatgaatacagatccttatcagctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaa

SEQ ID NO: 3 - protein, 871 aa, Homo sapiens
MKYSCCALVLAVLGTELLGSLCSTVRSPRFRGRIQQERKNIRPNIILVLTDDQDVELGSLQVMNKTRKIMEHGGATFINAFVTTPMCCPSRSSMLTGKYVHNHNVYTNNENCSSPSWQAMHEPRTFAVYLNNTGYRTAFFGKYLNEYNGSYIPPGWREWLGLIKNSRFYNYTVCRNGIKEKHGFDYAKDYFTDLITNESINYFKMSKRMYPHRPVMMVISHAAPHGPEDSAPQFSKLYPNASQHITPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSIVPQIVLNIDLAPTILDIAGLDTPPDVDGKSVLKLLDPEKPGNRFRTNKKAKIWRDTFLVERGKFLRKKEESSKNIQQSNHLPKYERVKELCQQARYQTACEQPGQKWQCIEDTSGKLRIHKCKGPSDLLTVRQSTRNLYARGFHDKDKECSCRESGYRASRSQRKSQRQFLRNQGTPKYKPRFVHTRQTRSLSVEFEGEIYDINLEEEEELQVLQPRNIAKRHDEGHKGPRDLQASSGGNRGRMLADSSNAVGPPTTVRVTHKCFILPNDSIHCERELYQSARAWKDHKAYIDKEIEALQDKIKNLREVRGHLKRRKPEECSCSKQSYYNKEKGVKKQEKLKSHLHPFKEAAQEVDSKLQLFKENNRRRKKERKEKRRQRKGEECSLPGLTCFTHDNNHWQTAPFWNLGSFCACTSSNNNTYWCLRTVNETHNFLFCEFATGFLEYFDMNTDPYQLTNTVHTVERGILNQLHVQLMELRSCQGYKQCNPRPKNLDVGNKDGGSYDLHRGQLWDGWEG

SEQ ID NO: 4 - DNA, 3363 bp, Homo sapiens
gactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagaaaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacgatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgaatccccacatcgtcctcaacattgacctggcccccaccatcctggacattgcaggcctggacatacctgcggatatggacgggaaatccatcctcaagctgctggacacggagcggccggtgaatcggtttcacttgaaaaagaagatgagggtctggcgggactccttcttggtggagagaggcaagctgctacacaagagagacaatgacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctgggacttaaagatggaggaagctatgagcaatacaggcagtttcagcgtcgaaagtggccagaaatgaagagaccttcttccaaatcactgggacaactgtgggaaggctgggaaggttaagaaacaacagaggtggacctccaaaaacatagaggcatcacctgactgcacaggcaatgaaaaaccatgtgggtgatttccagcagacctgtgctattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaaaaaaaaaaaaa

SEQ ID NO: 5 - DNA, 2616 bp, Homo sapiens
tgaatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagaaaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacgatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgaatccccacatcgtcctcaacattgacctggcccccaccatcctggacattgcaggcctggacatacctgcggatatggacgggaaatccatcctcaagctgctggacacggagcggccggtgaatcggtttcacttgaaaaagaagatgagggtctggcgggactccttcttggtggagagaggcaagctgctacacaagagagacaatgacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctgggacttaaagatggaggaagctatgagcaatacaggcagtttcagcgtcgaaagtggccagaaatgaagagaccttcttccaaatcactgggacaactgtgggaaggctgggaaggttaa

SEQ ID NO: 6 - protein, 870 aa, Homo sapiens
MGPPSLVLCLLSATVFSLLGGSSAFLSHHRLKGRFQRDRRNIRPNIILVLTDDQDVELGSMQVMNKTRRIMEQGGAHFINAFVTTPMCCPSRSSILTGKYVHNHNTYTNNENCSSPSWQAQHESRTFAVYLNSTGYRTAFFGKYLNEYNGSYVPPGWKEWVGLLKNSRFYNYTLCRNGVKEKHGSDYSKDYLTDLITNDSVSFFRTSKKMYPHRPVLMVISHAAPHGPEDSAPQYSRLFPNASQHITPSYNYAPNPDKHWIMRYTGPMKPIHMEFTNMLQRKRLQTLMSVDDSMETIYNMLVETGELDNTYIVYTADHGYHIGQFGLVKGKSMPYEFDIRVPFYVRGPNVEAGCLNPHIVLNIDLAPTILDIAGLDIPADMDGKSILKLLDTERPVNRFHLKKKMRVWRDSFLVERGKLLHKRDNDKVDAQEENFLPKYQRVKDLCQRAEYQTACEQLGQKWQCVEDATGKLKLHKCKGPMRLGGSRALSNLVPKYYGQGSEACTCDSGDYKLSLAGRRKKLFKKKYKASYVRSRSIRSVAIEVDGRVYHVGLGDAAQPRNLTKRHWPGAPEDQDDKDGGDFSGTGGLPDYSAANPIKVTHRCYILENDTVQCDLDLYKSLQAWKDHKLHIDHEIETLQNKIKNLREVRGHLKKKRPEECDCHKISYHTQHKGRLKHRGSSLHPFRKGLQEKDKVWLLREQKRKKKLRKLLKRLQNNDTCSMPGLTCFTHDNQHWQTAPFWTLGPFCACTSANNNTYWCMRTINETHNFLFCEFATGFLEYFDLNTDPYQLMNAVNTLDRDVLNQLHVQLMELRSCKGYKQCNPRTRNMDLGLKDGGSYEQYRQFQRRKWPEMKRPSSKSLGQLWEGWEG

SEQ ID NO: 7 - DNA, 3469 bp, Mus musculus
cttcaccttgagaaggtgaatttccctaaagacatgcagtttcttcaagccagaatccttgcagggaaccttcaaaggactccttctgcagatgttttggaaacctctgagtctagaaatcgattattcacccaggataccttattcaagctcccagaactcacccgaccaaggagcttggaagactttgcaactttggaccaagcacaatgaagtattccctctgggctctgctgcttcccctgctgggcacacagctgctgggaaccctgtgttccaccgttcggtcccagaggttccgaggaaggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcctacattgataaagagattgaagttctacaagataaaattaagaatttaagggaagtgaggggacacctaaagaaaaggaaacctgaggagtgtagctgtggtgaccagagctattacaacaaagagaaaggtgtcaaacgacaggagaagctaaagagtcaccttcaccccttcaaggaggctgctgcccaggaggtggatagcaaacttcagctcttcaaggagcatcggaggaggaagaaggagaggaaggagaagaaacggcagaggaagggagaggagtgtagcctgcctggccttacctgcttcacccatgacaacaaccactggcagactgccccattctggaacttgggatctttctgtgcctgcacaagttctaacaacaatacctactgggtgttgcgtacagtcaacgagacgcacaatttcctgttttgtgagtttgctactggctttctggaatatttcgacatgaatacggatccttatcagctcacaaatacagtacacacagtagaacgaggcattttgaatcagctacacgtacaactaatggagctcagaagctgtcaaggatataagcagtgcaacccaagacctaagaatcttgatgttggaaataaagatggaggaaactatgacccgcacagaggacagttatgggatggatgggaaggttagtctttccaatgttacttcagacaccagctggcaaggcctggaggagttatccggtgcaagcgacatcgatgagtacaggtctaaccctagactaagtctggaggactggactaactacctgagggctgtctacagagcctttgcactgctgaacagtcaccctgatccaaacaaagcaaatgggactccaaccacacaaggtggtgacttcctggtcacctctgctgagcgcttggtgccagcagagatggcttctgcagaatcaggtgaagacccaagtcatgtggttggggaaacacctcctttgaccttgccagtcaacctccaaaccctgcatctgaacagaccaacgttaagtccagagagaaaacttgaatgggataatgacattccagaagtgaatcatttgaattctgaacactggagaaaaactgagaagcagataggatgggaggagctgcatcatcctgaaggtgacgtcgtcagtggcaatggtatgacagagctgctgccccagtctcatcttgggcatcagctcaccagtcagcaccaacaaaaatgttcccaggatgtggagacagagaaggatgcttttgaagatcaattgcgtcctcttgtccactctgacagaactccggttcatc

SEQ ID NO: 8 - DNA, 2616 bp, Mus musculus
atgaagtattccctctgggctctgctgcttcccctgctgggcacacagctgctgggaaccctgtgttccaccgttcggtcccagaggttccgaggaaggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcctacattgataaagagattgaagttctacaagataaaattaagaatttaagggaagtgaggggacacctaaagaaaaggaaacctgaggagtgtagctgtggtgaccagagctattacaacaaagagaaaggtgtcaaacgacaggagaagctaaagagtcaccttcaccccttcaaggaggctgctgcccaggaggtggatagcaaacttcagctcttcaaggagcatcggaggaggaagaaggagaggaaggagaagaaacggcagaggaagggagaggagtgtagcctgcctggccttacctgcttcacccatgacaacaaccactggcagactgccccattctggaacttgggatctttctgtgcctgcacaagttctaacaacaatacctactgggtgttgcgtacagtcaacgagacgcacaatttcctgttttgtgagtttgctactggctttctggaatatttcgacatgaatacggatccttatcagctcacaaatacagtacacacagtagaacgaggcattttgaatcagctacacgtacaactaatggagctcagaagctgtcaaggatataagcagtgcaacccaagacctaagaatcttgatgttggaaataaagatggaggaaactatgacccgcacagaggacagttatgggatggatgggaaggttag

SEQ ID NO: 9 - protein, 232 aa, Mus musculus
MKYSLWALLLPLLGTQLLGTLCSTVRSQRFRGRIQQEAWKDHKAYIDKEIEVLQDKIKNLREVRGHLKKRKPEECSCGDQSYYNKEKGVKRQEKLKSHLHPFKEAAAQEVDSKLQLFKEHRRRKKERKEKKRQRKGEECSLPGLTCFTHDNNHWQTAPFWNLGSFCACTSSNNNTYWVLRTVNETHNFLFCEFATGFLEYFDMNTDPYQLTNTVHTVNYDPHRGQLWDGWEG

SEQ ID NO: 10 - DNA, 3766 bp, Mus musculus
ggacgcgtgggcggacgcgtggggtctgggcaacgcttctgctttcgcttgagctcaacttaatttctcagagagcttcggagacgcgtgggaaggtcccaggcgcgtgggcagttcctcccgcgatctagcttggggatcggcccgagccggcgtctccaatgatcctgagggaagaggggaaggaatcccatcctcacgacaccacctcggcctctgcatccaggaagaagcaaaggaccagcaagccacgccaatggcaccccctggcctgccactatggctgctgtccaccgctctcctctccctgctggctggcagctcggccttcctctcccatccccgcctgaagggacgcttccagagggaccgcaggaacatccggcccaacatcatcttggtgcttacggatgaccaggatgtggagctgggctccatgcaagtgatgaacaagacaaggcgtatcatggagcagggcggggcgcacttcatcaatgccttcgtgactacaccaatgtgctgtccgtctcgctcctccattctcaccggcaagtacgtccacaaccacaacacctacaccaacaatgagaattgttcctcgccctcctggcaggcccagcacgagagccgcaccttcgccgtgtatctcaacagcacaggctaccggacagctttcttcggaaaatacctcaatgagtacaacggctcatacgtgccgcccggctggaaggagtgggtcggcctacttaagaactcccgcttttataactacacactctgccggaatggggtgaaggagaaacatggctcagactactccacggattacctcacggatctcatcaccaatgacagtgtgagcttcttccgaacatccaagaagatgtacccacacaggcccgtgctcatggtcatcagccacgcggctccccacggccccgaggactcggcaccgcagtactcacggctcttccccaatgcgtcccagcacatcacaccgagttacaactatgcacccaacccagacaagcattggatcatgcgctacacgggacccatgaagcccattcacatggaattcaccaacatgctacaacgcaaacgcctacagaccctcatgtctgtggatgactccatggagacgatctatgacatgctggtggagacgggggagctggacaacacgtacatcctgtacaccgccgaccacggctaccacattggccagtttgggctggtgaagggcaagtctatgccgtatgaattcgacatcagagtcccgttctacgtgaggggccccaacgtggaagctggctctctgaacccccacattgtcctcaacattgacctggcccccaccatactggatatcgctggactggacatccctgcagacatggacgggaagtctattctcaaactactggactcagagcggccagtgaaccggttccacttgaaaaagaagctgagggtctggcgagactccttcctggtggagagaggcaaactgctccacaagagggagggtgacaaagtgaatgcccaggaggagaacttcctgcccaagtaccagcgcgtgaaggacctgtgtcagcgagctgagtaccagacagcatgcgaacagctggggcagaagtggcagtgtgtggaggacgcttctgggacgctgaagctgcacaaatgtaaaggccccatgcggtttggtggcggcggtggcagcagagccctctccaacctggtgcccaagtatgacggccagagcagcgaggcctgcagctgtgacagtggcggtggaggggactacaaactgggcctggctggacgccgtaagctctttaagaaaaagtataagaccagctatgcccggaaccgctccatccgttccgtggccatcgaggtggacggtgagatataccacgtaggcttggatactgtgcctcagccccgcaaccttagcaagccgcactggccaggggcccctgaagaccaagatgacaaggatggtggcagtttcagtggtactggtggccttccagattattctgcccccaatcccatcaaagtgacccatcggtgctacatccttgagaatgacacagtccagtgcgacttggacctgtacaagtccctgcaggcttggaaagaccacaagctgcacatcgaccatgagatcgaaaccctgcagaacaaaattaagaaccttcgagaagtcaggggtcacctgaagaagaagcgaccggaagaatgtgactgccataaaatcagttaccacagccaacacaaaggccgtctcaagcacaaaggctccagcctgcaccctttcaggaagggtctgcaggagaaggacaaggtgtggctgctgcgggagcagaaacgcaagaagaaactgcgcaagctgctcaaacggctgcagaacaacgatacgtgcagcatgcccggcctcacgtgctttacccacgacaaccaccactggcagacggcgccactctggacgctggggccgttctgcgcctgcaccagcgccaacaacaacacgtactggtgcttgaggaccataaatgagacccacaacttcctcttctgcgaatttgcaaccggcttcatagaatactttgacctcagtacagacccctaccagctgatgaacgcggtgaacacactggacagggacgtccttaaccaactgcacgtgcagctcatggagctaaggagctgtaaaggctacaagcagtgcaacccccggacccgcaacatggacctggggcttagagacggaggaagctatgaacaatacaggcagtttcagcgtcgaaaatggccagaaatgaagagaccttcttccaaatcactgggacagctatgggaaggttgggaaggctaagcggccatagagagaggaacctccaaaaccaggggcctcgtgtggctgcccaggccatgcaaaaaacacccgattcccagaagatgaatgttggaactgggagacctgacagaaggcagggctgctcttgggacaggaaatcctggaggacagcgcctggactttccgatgctcagtttctttgccctgctttgctctggatcaaacctcactggctgctctgggatgcgtgctcacacctggagtctctgctcaccctttcagaggctcacaaagacaaaggaactaatttccatggacacttcctccagagatggaaattgctgggattcgcccactcctcccctgcacccctcccccagtcatctagggaagcaagcttgttttaaccttcttactctttggagaaagcacggacatcccaggtgctgtcaacctcacagtcttgacaaagtctatagcacaaaacagtaccattcaccaggctggttgacctggctggctcagaagctgccttcaccacatacatgaccgctcacacgtaaccaacacagggaattgtaggggaatctcactaatatgaaatcccgcttttcaagagtcgcggtgtcaataaacgctgtggctaggatcaaggataatcccttgagctttcagacatttattcctgcccgggattcgttcctttgttatccatcccagaactgatgtttttctaaggtaccgaaaccccaagttgatgtgtgtcctgtgttttaatgacattgtatttgtaaagttttgtagtataagtaccatcttacagtgttcctgcccccagccaatgtctagctattggtatgaaaaaaaaaaatctttgaatttttgtaaaaaaaaaaaaaa

SEQ ID NO: 11 - DNA, 2628 bp, Mus musculus
atggcaccccctggcctgccactatggctgctgtccaccgctctcctctccctgctggctggcagctcggccttcctctcccatccccgcctgaagggacgcttccagagggaccgcaggaacatccggcccaacatcatcttggtgcttacggatgaccaggatgtggagctgggctccatgcaagtgatgaacaagacaaggcgtatcatggagcagggcggggcgcacttcatcaatgccttcgtgactacaccaatgtgctgtccgtctcgctcctccattctcaccggcaagtacgtccacaaccacaacacctacaccaacaatgagaattgttcctcgccctcctggcaggcccagcacgagagccgcaccttcgccgtgtatctcaacagcacaggctaccggacagctttcttcggaaaatacctcaatgagtacaacggctcatacgtgccgcccggctggaaggagtgggtcggcctacttaagaactcccgcttttataactacacactctgccggaatggggtgaaggagaaacatggctcagactactccacggattacctcacggatctcatcaccaatgacagtgtgagcttcttccgaacatccaagaagatgtacccacacaggcccgtgctcatggtcatcagccacgcggctccccacggccccgaggactcggcaccgcagtactcacggctcttccccaatgcgtcccagcacatcacaccgagttacaactatgcacccaacccagacaagcattggatcatgcgctacacgggacccatgaagcccattcacatggaattcaccaacatgctacaacgcaaacgcctacagaccctcatgtctgtggatgactccatggagacgatctatgacatgctggtggagacgggggagctggacaacacgtacatcctgtacaccgccgaccacggctaccacattggccagtttgggctggtgaagggcaagtctatgccgtatgaattcgacatcagagtcccgttctacgtgaggggccccaacgtggaagctggctctctgaacccccacattgtcctcaacattgacctggcccccaccatactggatatcgctggactggacatccctgcagacatggacgggaagtctattctcaaactactggactcagagcggccagtgaaccggttccacttgaaaaagaagctgagggtctggcgagactccttcctggtggagagaggcaaactgctccacaagagggagggtgacaaagtgaatgcccaggaggagaacttcctgcccaagtaccagcgcgtgaaggacctgtgtcagcgagctgagtaccagacagcatgcgaacagctggggcagaagtggcagtgtgtggaggacgcttctgggacgctgaagctgcacaaatgtaaaggccccatgcggtttggtggcggcggtggcagcagagccctctccaacctggtgcccaagtatgacggccagagcagcgaggcctgcagctgtgacagtggcggtggaggggactacaaactgggcctggctggacgccgtaagctctttaagaaaaagtataagaccagctatgcccggaaccgctccatccgttccgtggccatcgaggtggacggtgagatataccacgtaggcttggatactgtgcctcagccccgcaaccttagcaagccgcactggccaggggcccctgaagaccaagatgacaaggatggtggcagtttcagtggtactggtggccttccagattattctgcccccaatcccatcaaagtgacccatcggtgctacatccttgagaatgacacagtccagtgcgacttggacctgtacaagtccctgcaggcttggaaagaccacaagctgcacatcgaccatgagatcgaaaccctgcagaacaaaattaagaaccttcgagaagtcaggggtcacctgaagaagaagcgaccggaagaatgtgactgccataaaatcagttaccacagccaacacaaaggccgtctcaagcacaaaggctccagcctgcaccctttcaggaagggtctgcaggagaaggacaaggtgtggctgctgcgggagcagaaacgcaagaagaaactgcgcaagctgctcaaacggctgcagaacaacgatacgtgcagcatgcccggcctcacgtgctttacccacgacaaccaccactggcagacggcgccactctggacgctggggccgttctgcgcctgcaccagcgccaacaacaacacgtactggtgcttgaggaccataaatgagacccacaacttcctcttctgcgaatttgcaaccggcttcatagaatactttgacctcagtacagacccctaccagctgatgaacgcggtgaacacactggacagggacgtccttaaccaactgcacgtgcagctcatggagctaaggagctgtaaaggctacaagcagtgcaacccccggacccgcaacatggacctggggcttagagacggaggaagctatgaacaatacaggcagtttcagcgtcgaaaatggccagaaatgaagagaccttcttccaaatcactgggacagctatgggaaggttgggaaggctaa

SEQ ID NO: 12 - protein, 875 aa, Mus musculus
MAPPGLPLWLLSTALLSLLAGSSAFLSHPRLKGRFQRDRRNIRPNIILVLTDDQDVELGSMQVMNKTRRIMEQGGAHFINAFVTTPMCCPSRSSILTGKYVHNHNTYTNNENCSSPSWQAQHESRTFAVYLNSTGYRTAFFGKYLNEYNGSYVPPGWKEWVGLLKNSRFYNYTLCRNGVKEKHGSDYSTDYLTDLITNDSVSFFRTSKKMYPHRPVLMVISHAAPHGPEDSAPQYSRLFPNASQHITPSYNYAPNPDKHWIMRYTGPMKPIHMEFTNMLQRKRLQTLMSVDDSMETIYDMLVETGELDNTYILYTADHGYHIGQFGLVKGKSMPYEFDIRVPFYVRGPNVEAGSLNPHIVLNIDLAPTILDIAGLDIPADMDGKSILKLLDSERPVNRFHLKKKLRVWRDSFLVERGKLLHKREGDKVNAQEENFLPKYQRVKDLCQRAEYQTACEQLGQKWQCVEDASGTLKLHKCKGPMRFGGGGGSRALSNLVPKYDGQSSEACSCDSGGGGDYKLGLAGRRKLFKKKYKTSYARNRSIRSVAIEVDGEIYHVGLDTVPQPRNLSKPHWPGAPEDQDDKDGGSFSGTGGLPDYSAPNPIKVTHRCYILENDTVQCDLDLYKSLQAWKDHKLHIDHEIETLQNKIKNLREVRGHLKKKRPEECDCHKISYHSQHKGRLKHKGSSLHPFRKGLQEKDKVWLLREQKRKKKLRKLLKRLQNNDTCSMPGLTCFTHDNHHWQTAPLWTLGPFCACTSANNNTYWCLRTINETHNFLFCEFATGFIEYFDLSTDPYQLMNAVNTLDRDVLNQLHVQLMELRSCKGYKQCNPRTRNMDLGLRDGGSYEQYRQFQRRKWPEMKRPSSKSLGQLWEGWEG

SEQ ID NO: 13 - DNA, 4286 bp, Homo sapiens
ggcacgagggccatttctggacaacagctgctattttcacttgagcccaagttaatttctcggggagttctcgggcgcgcacaggcagctcggtttgccctgcgattgagctgcgggtcgcggccggcgccggcctctccaatggcaaatgtgtgtggctggaggcgagcgcgaggctttcggcaaaggcagtcgagtgtttgcagaccggggcgagtcctgtgaaagcagataaaagaaaacatttattaacgtgtcattacgaggggagcgcccggccggggctgtcgcactccccgcggaacatttggctccctccagctcctagagaggagaagaagaaagcggaaaagaggcagattcacgtcgtttccagccaagtggacctgatcgatggccctcctgaatttatcacgatatttgatttattagcgatgccccctggtttgtgtgttacgcacacacacgtgcacacaaggctctggctcgcttccctccctcgtttccagctcctgggcgaatcccacatctgtttcaactctccgccgagggcgagcaggagcgagagtgtgtcgaatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcaccggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacgatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgaatccccacatcgtcctcaacattgacctggcccccaccatcctggacattgcaggcctggacatacctgcggatatggacgggaaatccatcctcaagctgctggacacggagcggccggtgaatcggtttcacttgaaaaagaagatgagggtctggcgggactccttcttggtggagagaggcaagctgctacacaagagagacaatgacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctgggacttaaagatggaggaagctatgagcaatacaggcagtttcagcgtcgaaagtggccagaaatgaagagaccttcttccaaatcactgggacaactgtgggaaggctgggaaggttaagaaacaacagaggtggacctccaaaaacatagaggcatcacctgactgcacaggcaatgaaaaaccatgtgggtgatttccagcagacctgtgctattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcatataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaaaaaaaaaaaattgtggacatttctgttcctgtccagataccatttctcctagtatttctttgttatgtcccagaactgatgttttttttttaaggtactgaaaagaaatgaagttgatgtatgtcccaagttttgatgaaactgtatttgtaaaaaaaattttgtagtttaagtattgtcatacagtgttcaaaaccccagccaatgaccagcagttggtatgaagaacctttgacattttgtaaaaggccatttcttggggaaaaaaaaaaaaaaaaaaaaaaaaaaaaaaaaaaaaaaaaaa

SEQ ID NO: 14 - DNA, 3289 bp, Homo sapiens
ggcacgagggccatttctggacaacagctgctattttcacttgagcccaagttaatttctcggggagttctcgggcgcgcacaggcagctcggtttgccctgcgattgagctgcgggtcgcggccggcgccggcctctccaatggcaaatgtgtgtggctggaggcgagcgcgaggctttcggcaaaggcagtcgagtgtttgcagaccggggcgagtcctgtgaaagcagataaaagaaaacatttattaacgtgtcattacgaggggagcgcccggccggggctgtcgcactccccgcggaacatttggctccctccagctcctagagaggagaagaagaaagcggaaaagaggcagattcacgtcgtttccagccaagtggacctgatcgatggccctcctgaatttatcacgatatttgatttattagcgatgccccctggtttgtgtgttacgcacacacacgtgcacacaaggctctggctcgcttccctccctcgtttccagctcctgggcgaatcccacatctgtttcaactctccgccgagggcgagcaggagcgagagtgtgtcgaatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcaccggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacgatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgaatccccacatcgtcctcaacattgacctggcccccaccatcctggacattgcaggcctggacatacctgcggatatggacgggaaatccatcctcaagctgctggacacggagcggccggtgaatcggtttcacttgaaaaagaagatgagggtctggcgggactccttcttggtggagagaggcaagctgctacacaagagagacaatgacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctgggacttaaagatggaggaagctatgagcaatacaggcagtttcagcgtcgaaagtggccagaaatgaagagaccttcttccaaatcactgggacaactgtgggaaggctgggaaggttaa

SEQ ID NO: 15 - protein, 870 aa, Homo sapiens; identical to SEQ ID NO: 6

SEQ ID NO: 16 - DNA, 3613 bp, Mus musculus
ggcggcggagatcctgagggaagaggggaaggaatcccatcctcacgacaccacctcggcctctgcatccaggaagaagcaaaggaccagcaagccacgccaatggcaccccctggcctgccactatggctgctgtccaccgctctcctctccctgctggctggcagctcggccttcctctcccatccccgcctgaagggacgcttccagagggaccgcaggaacatccggcccaacatcatcttggtgcttacggatgaccaggatgtggagctgggctccatgcaagtgatgaacaagacaaggcgtatcatggagcagggcggggcgcacttcatcaatgccttcgtgactacaccaatgtgctgtccgtctcgctcctccattctcaccggcaagtacgtccacaaccacaacacctacaccaacaatgagaattgttcctcgccctcctggcaggcccagcacgagagccgcaccttcgccgtgtatctcaacagcacaggctaccggacagctttcttcggaaaatacctcaatgagtacaacggctcatacgtgccgcccggctggaaggagtgggtcggcctacttaagaactcccgcttttataactacacactctgccggaatggggtgaaggagaaacatggctcggactactccacggattacctcacggatctcatcaccaatgacagtgtgagcttcttccgaacatccaagaagatgtacccacacaggcccgtgctcatggtcatcagccacgcggctccccatggccccgaggactcagcaccccagtactcacggctcttccccaatgcgtcccagcacatcacaccgagttacaactatgcacccaacccagacaagcattggatcatgcgctacacgggacccatgaagcccattcacatggaattcaccaacatgctacaacgaaaacgcctacagaccctcatgtctgtggatgactccatggagacgatctatgacatgctggtggagacgggggagctggacaacacgtacatcctgtacaccgccgaccacggctaccacattggccagtttgggctggtgaagggcaagtctatgccgtatgaattcgacatcagagtcccgttctacgtgaggggccccaacgtggaagctggctctctgaacccccacattgtcctcaacattgacctggcccccaccatactggatatcgctggactggacatccctgcagacatggacgggaagtctattctcaaactactggactcagagcggccagtgaaccggttccacttgaaaaagaagctgagggtctggcgagactccttcctggtggagagaggcaaactgctccacaagagggagggtgacaaagtgaatgcccaggaggagaacttcctgcccaagtaccagcgcgtgaaggacctgtgtcagcgagctgagtaccagacagcatgcgaacagctggggcagaagtggcagtgtgtggaggacgcttctgggacgctgaagctgcacaaatgtaaaggccccatgcggtttggtggcggcggtggcagcagagccctctccaacctggtgcccaagtatgacggccagagcagcgaggcctgcagctgtgacagtggcggtggaggggactacaaactgggcctggctggacgccgtaagctctttaagaaaaagtataagaccagctatgcccggaaccgctccatccgttccgtggccatcgaggtggacggtgagatataccacgtaggcttggatactgtacctcagccccgcaaccttagcaagccgcactggccaggggcccctgaagaccaagatgacaaggatggtggcagtttcagtggtactggtggccttccagattattctgcccccaatcccatcaaagtgacccatcggtgctacatccttgagaatgacacagtccagtgcgacttggacctgtacaagtccctgcaggcttggaaagaccacaagctgcacatcgaccatgagatcgaaaccctgcagaacaaaattaagaaccttcgagaagtcaggggtcacctgaagaagaagcgaccggaagaatgtgactgccataaaatcagttaccacagccaacacaaaggccgtctcaagcacaaaggctccagcctgcaccctttcaggaagggtctgcaggagaaggacaaggtgtggctgctgcgggagcagaaacgcaagaagaaactgcgcaagctgctcaaacggctgcagaacaacgatacgtgcagcatgcccggcctcacgtgctttacccacgacaaccaccactggcagacggcgccactctggacgctggggccgttctgcgcctgcaccagcgccaacaacaacacgtactggtgcttgaggaccataaatgagacccacaacttcctcttctgcgaatttgcaaccggcttcatagaatactttgacctcagtacagacccctaccagctgatgaacgcggtgaacacactggacagggacgtccttaaccaactgcacgtgcagctcatggagctaaggagctgtaaaggctacaagcagtgcaacccccggacccgcaacatggacctggggcttagagacggaggaagctatgaacaatacaggcagtttcagcgtcgaaaatggccagaaatgaagagaccttcttccaaatcactgggacagctatgggaaggttgggaaggctaagcggccatagagagaggaacctccaaaaccaggggcctcgtgtggctgcccaggccatgcaaaaaacacccgattcccagaagatgaatgttggaactgggagacctgacagaaggcagggcctgctcttgggacaggaaatcctggaggacagcgcctggactttccgatgctcagtttctttgccctgctttgctctggatcaaacctcactggctgctctgggatgcgtgctcacacctggagtctctgctcaccctttcagaggctcacaaagacaaaggaactaatttccatggacacttcctccagagatggaaattgctgggattcgcccactcctcccctgcacccctcccccagtcatctagggaagcaagcttgttttaaccttcttactctttggagaaagcacggacatcccaggtgctgtcaacctcacagtcttgacaaagtctatagcacaaaacagtaccattcaccaggctggttgacctggctggctcagaagctgccttcaccacatacatgaccgctcacacgtaaccaacacagggaattgtaggggaatctcactaatatgaaatcccgcttttcaagagtcgcggtgtcaataaacgctgtggctaggatcaaggataatcccttgagctttcagacatttattcctgcccgggattcgttcctttgttatccatcccagaactgatgtttttctaaggtaccgaaaccccaagttgatgtgtgtcctgtgttttaatgacattgtatttgtaaagttttgtagtataagtaccatcttacagtgttcctgcccccagccaatgtctagctattggtatgaaaaaaaaatctttgaatttttgtaaaaaaaaaaaaaaaa

SEQ ID NO: 17 - DNA, 2628 bp, Mus musculus
atggcaccccctggcctgccactatggctgctgtccaccgctctcctctccctgctggctggcagctcggccttcctctcccatccccgcctgaagggacgcttccagagggaccgcaggaacatccggcccaacatcatcttggtgcttacggatgaccaggatgtggagctgggctccatgcaagtgatgaacaagacaaggcgtatcatggagcagggcggggcgcacttcatcaatgccttcgtgactacaccaatgtgctgtccgtctcgctcctccattctcaccggcaagtacgtccacaaccacaacacctacaccaacaatgagaattgttcctcgccctcctggcaggcccagcacgagagccgcaccttcgccgtgtatctcaacagcacaggctaccggacagctttcttcggaaaatacctcaatgagtacaacggctcatacgtgccgcccggctggaaggagtgggtcggcctacttaagaactcccgcttttataactacacactctgccggaatggggtgaaggagaaacatggctcggactactccacggattacctcacggatctcatcaccaatgacagtgtgagcttcttccgaacatccaagaagatgtacccacacaggcccgtgctcatggtcatcagccacgcggctccccatggccccgaggactcagcaccccagtactcacggctcttccccaatgcgtcccagcacatcacaccgagttacaactatgcacccaacccagacaagcattggatcatgcgctacacgggacccatgaagcccattcacatggaattcaccaacatgctacaacgaaaacgcctacagaccctcatgtctgtggatgactccatggagacgatctatgacatgctggtggagacgggggagctggacaacacgtacatcctgtacaccgccgaccacggctaccacattggccagtttgggctggtgaagggcaagtctatgccgtatgaattcgacatcagagtcccgttctacgtgaggggccccaacgtggaagctggctctctgaacccccacattgtcctcaacattgacctggcccccaccatactggatatcgctggactggacatccctgcagacatggacgggaagtctattctcaaactactggactcagagcggccagtgaaccggttccacttgaaaaagaagctgagggtctggcgagactccttcctggtggagagaggcaaactgctccacaagagggagggtgacaaagtgaatgcccaggaggagaacttcctgcccaagtaccagcgcgtgaaggacctgtgtcagcgagctgagtaccagacagcatgcgaacagctggggcagaagtggcagtgtgtggaggacgcttctgggacgctgaagctgcacaaatgtaaaggccccatgcggtttggtggcggcggtggcagcagagccctctccaacctggtgcccaagtatgacggccagagcagcgaggcctgcagctgtgacagtggcggtggaggggactacaaactgggcctggctggacgccgtaagctctttaagaaaaagtataagaccagctatgcccggaaccgctccatccgttccgtggccatcgaggtggacggtgagatataccacgtaggcttggatactgtacctcagccccgcaaccttagcaagccgcactggccaggggcccctgaagaccaagatgacaaggatggtggcagtttcagtggtactggtggccttccagattattctgcccccaatcccatcaaagtgacccatcggtgctacatccttgagaatgacacagtccagtgcgacttggacctgtacaagtccctgcaggcttggaaagaccacaagctgcacatcgaccatgagatcgaaaccctgcagaacaaaattaagaaccttcgagaagtcaggggtcacctgaagaagaagcgaccggaagaatgtgactgccataaaatcagttaccacagccaacacaaaggccgtctcaagcacaaaggctccagcctgcaccctttcaggaagggtctgcaggagaaggacaaggtgtggctgctgcgggagcagaaacgcaagaagaaactgcgcaagctgctcaaacggctgcagaacaacgatacgtgcagcatgcccggcctcacgtgctttacccacgacaaccaccactggcagacggcgccactctggacgctggggccgttctgcgcctgcaccagcgccaacaacaacacgtactggtgcttgaggaccataaatgagacccacaacttcctcttctgcgaatttgcaaccggcttcatagaatactttgacctcagtacagacccctaccagctgatgaacgcggtgaacacactggacagggacgtccttaaccaactgcacgtgcagctcatggagctaaggagctgtaaaggctacaagcagtgcaacccccggacccgcaacatggacctggggcttagagacggaggaagctatgaacaatacaggcagtttcagcgtcgaaaatggccagaaatgaagagaccttcttccaaatcactgggacagctatgggaaggttgggaaggctaa

SEQ ID NO: 18 - protein, 875 aa, Mus musculus; identical to SEQ ID NO: 12

SEQ ID NO: 19 - protein, 10 aa, Artificial Sequence
  artificial protein
CYPYDVPDYA

SEQ ID NO: 20 - protein, 8 aa, Artificial Sequence
  synthetic protein
DYKDDDDK

SEQ ID NO: 21 - protein, 11 aa, Artificial Sequence
  synthetic protein
CEQKLISEEDL

SEQ ID NO: 22 - DNA, 268685 bp, Homo sapiens
  misc_feature (1)...(268685): N = A,T,C or G
gaattctagagcatctcacagatagaatgggggtaaaagaagaaacaacacacttgcaaatttgatgaaatttcccacatggtcctgaaatcgctggtggaatgggggattgcagtccgggtatgaggcattcgagagaatctgaatgtgtcccccaaagtgctccccagagactagcactgatcaggccgtggaaagcccaaggccctacacgacaggttctgggctctgctttccttgaacacctggtagaggggctggggagagaggcagaggctgagaatggctggagacaaatggtcagattcggttcttttatctgtagcagggactcaaacccagggtgtcctggctgctggaaggttgagcaatgctgagccgtatttccacacatggcttcactggcagaagcagggctgtcctgtggccgagaacccctcttccagccctgcacgggtcccctgacccctaggcctgcaggcattcacatacccccctgcaaagcccccaaccctccttgggcaaggacaggcacagcttcaggacatcgtcctcctgccctatgtgggcagagttgagaccccagagctgagagggaggctccccaatacccatctccccgataatggccaatgctccacaaagggtcacttccaaagaatgccaggtggcaggcaccaggttttggcatctgatatgctcccatccgctccctgggtccaaagcattcatcctttgtaatctctgacggggaacaactggctgttgtcctttaattagcaggggacacactaagctatggtctcctgcaggctccataaacatccgtgaaatcagcctggtgactccaagctcggtgcagactgcggggacccatagtggccaagaccccgtccctggtctggctctgcgaacagcctccaggagaaactgccaagccgctgggactcgtggcagctgctcaagctggcaagttctttcttgcaaattgagatccaggctgcaatctgggctggctctgcacattctgggtgcccgttatctgctggttggagctgcctggacacctctgagggctgcttgtgcatgggtgggggctgcttttgaacacatggctgtcccatgggccgcgccttctccacttcttctggcctgattaaatgatggttattgcagggaggatgcagggccaagcatcctcttatgcagcaccatgagatgcggggtgtccagtgtcccaggagaaattccagcctcatttccctctgagacactgggaagaggccacgtgcagtctcagtgcccggatcccaggtgcgtagtctgagtctgcatgaggtgccaaggtctggccctgggctgtgtgggatgagattgaagtgtgtctgatgggagggcccaggtcgcacccaccaggtgccaagagtgcacagatgtagacgccagtgcctgcccaagtcacccaaaacggagaaagggaggcgctgggaagccctcgggccagaggctgatgacgtggaatcctcgaggggactgcctgctgctcagggtagaaggggacatcctaatgcggcacccatgacagccccccaccattcctgcccctcagacccactgtccctggagacctgcagagggaaccactgctgaagagaaggcgtctccgtcacttgctttgtctccccttggtcaccacaaagacagatgctcccagccctcaggtgacaagcttgtgtttctgcccccttctgatacccctgctctacgggtgtggccactgctcctggcttgcagtgtctgtgcggctatgacagcccaggttcctctcagggcgggtgtccctcctgcagaaagctcaccctgtctcctgggccctggccctgctcctggacagaggagggaaggactggggtggtggctgatggattctcaggtcacctttttcctgtattcccctgggctcttccttcagagcctccaccctgcaccctgatgactcactgcatctcatgtaggaagcccccggtgacatctcatgccctgtacacaggtccctgcagcctgggcccctcctcagctctgctgcctctggcggaaaccccactttcacccctccctccttacgtctggcggggattgcagggggcttgttggagggaagccacatgtgagacccacatgacacaccaacctcccactgtgcagaccgcaccccatctattttcttccgtcccttctgcagtcaacacagccctggctctgcattcggccctctcttcacagggctgtgtctgggcagatggggctggaaaacaacttgctgggcccagctggggtgtgttgtggatgtcacagcccggcctgtgcaacaggaggctccaggatccctttaggggtagggtagggggcgggggaatgcaggttaaatgggatgggcaggggcaggcaggcaacaggggtgattaatttttctcaaagcgttgccaggctacctttcaattccttgtctgtggcccaggccaaggaaagcaaatgttctgctgccaacctggcttgtcttttaatcataccctttgcttgtcagtttagacaccctggtatattctcattgctttttagcaatctttgcaacttgctggacttttccacccaaataggaacagtagatcatgtgtactgtgtgccaggcactgtgctaaatgcattagctatttcaatcctcacaatagccctatgagatgggcactatcattatccttattctgtagacgaggaaattcgcacagagaggttaattaattagcccagagtcactcagctagtgagtggcagagctgagatttgaacctaggcagcctggcttcagggtctatgctcttaatctctcactgtaggggctcttaagtgagtttccagcttccatggcttcagttgaagggacttctctgtggaggcagggctaggaggaattttatccatgggtcctacagcagccatctagaaggatgggattggctgtgactcagactctacccttggtgctgcctctgcctggagctctgtcccctggctcatcccaggatctgctccgtctccctcctcaggactcaagtgcagcattgcagaggatgtttgctgagcacctgctatctgccaggcactgtgctaggtgcaggggatcttgcaacaaacaaaattcctgcttttatggagcacacattcagtaagtggagagggataaacaaatcagtgaaaggtatgcatgtcagctgctaatccatgctacagggagacattcagcaggcttggggataggaagctccaggtatgtgggagggtgtgttagcttcctgtggttgctatgacgaatcaccaccaacctgatagcttcacacaacacatatggactctctcctagctctggaggtcaggagtctgccgtcagtttcactgggctaagtcaaggtgtcaacagggctggctcctgctggatgccctgagggcaggactctttgcattttcagtgtctgtatttccttccttctttccttcctttctttgtttcttcctttcttcctttctttctttctttttctttctttctcccttcccttctcttcctttcctttctttccttcctcccttcctttctcccttctctttctcctccctttcattccccttccctccttcccttcccttccttctcctcccctcccctcctctttctttctttctctttctttccttctttcttctctccctctctttctctttctccctccccttccctctccttccctccctccctccctccctccttycytkssskkccttccccttccccttccacttcccccttcccttcccttcccttccccttccttccttccttccttttttttcctctctgtctttgtctctttcttttttttagagacagagtctcgctctgtcacccaggctagagtgcagtggtgcaatcttggctcactgcagcctctgcctcctgggttcaagtgattctcctgcctcggcttcccaagtagctgagactacagatgcgcaccaccaggtccagctaatgttttttgtattattagtagacacagggtttcaccatgttggccaggctggtcttgaaatcctgacctcaagtgatctacccgcctcggcctcccaaagtgctggtctggcctgtattttcttttgagcccctcatactcctgggagcgtggctccttcctccatcctcaagcacatgattccagtctctgccctgtcactacagctcctctgactcagaccctcctgccctcctcttataaagaccctgtgattacactgggcccacccaggtcatccagagtcatctttccatctcaagatccttcactttacaccagcaaagcgcctttgcaatggacatacacacagggcccaggggttttaatgtggacacatatggggggcccttgttcagccccctatggaaggtggttgttgattttcagtaggatggtcagggaagaccctgctgagaagccaccatttgagccaagactggaggagctgaggctgcgggccaggatgacatcgagggtggagccttccaggcaaaaaaacagtgagtacaaagccagcaacaggtgtgctggcatgttcccggaaaaccggggagggagccacagctgcggccgagtgaggagaggagcagcgggaggtgaggccagagaagccttggaggcagaagctgcgggcctcatggttatcatgaagctccgggttttactctgagtacgcgggagccatggagagttctgagcagaggaagcacaggacctgacctgggtttcacaggcttcctctggctgctgtgtggaaaataggtaaatagggcaagagtggaagaagggaggcctgtcgggaagcttttgcacaatggcccgggtgagaaagactcatggcttggagcagatgctgggatgtgtcccccacatcccctttcaggagcaggcacgcatgccccactgcccagggggttgcctgctgagagctcacagctgagaccctccccagaaaatgcccctggctgacaggagctgctttgcccagtcacccttcctggggtccctccatctccaaagactagtagtaaacacaggggtctaaaggtccagccccttgactcaattcttcgcagttctgaagggccgtcttcactgcagacttcctcgaaggatggattgcaaagtcatgtgtagagtgtgcagggctcgggtgaatgtctatatgtctctctatattttaggatcgctgtctacattagcaatttgtttaaaaatatatttcaaaattcctgtgcccacgtgaggtctagtgatttatccatgaaggtatagaataacggatagagaagggatacttatgtggtttgttgtccgacagatcgtgtgaaagtttttcgtcatgtccaggcaccacctcttcccggtcaggcccacgttacatacgaggacaatggaacaagtcaaaggcaaagcaacacgtccccctgtaaaaactgtcagtgtaaccgtccacttccgtatctgtccagtcacttaacaaacattgacggaccacctttaaacacaggctgctgtgctggtgtctgggacacagcggtgagtaagagccatctgatctcatgacactctcaggaagttccagtctatgaggatggacagcatgcaggtcaacacataaacatcattcagactgtgaaaaatacaacaaaggacacagattgggagatgggataaagagtcatgggggtggagctactgtctcattttgggtggtctgggaaggcctctctgaggaggtgacatgtgggctgagtcctgaaggataagaaggggctgccatgggtgatttgagggaacagtgtgctaggtgggaggaacagcaagtgctaaggccagagatcaggcagatcagagatgaggccagggtatctaagaagtcaggagagtgctaagagatggggatgcagagacactgtcaggtgaaaaagaaagagaagggagccaggtgtggtggctgacacctataatcccagcactttgggaggcagaggtgggcaggttgcttgagcccaggagtttgagatcagcctggacaacgtggccagacctcatgtctaaaaaaaaaaaaaaaaaaaaaaaaaaaaaaacagacgtggcacatgcctgaggtcccagctactgaggaggcaggaggatcatctgagcctggaaggttgaggctgcagtgagtcaagatcatgcccctgtaatccagcctgggtgggtgacagaacaagaacctgtgtcaaaaaaaaaaaaagaaaagaaaagaaaaaaaggaaagggaagagaattgtcacattttattgcgacgacagtgttttgtttatttaaaatattttctctcccctttgagtccagcctgacactcaggagatggggagagccttcctctcactccgcctcaggaggagctcgaacctgctcccttaaatctccatcagctccgcaagcacttgggctctgctggctgtaacgctgctccctgtttaccagaggcttttgctggcacatgtatcactcagactctgaactagatcaagccacagaaaacttcgattcatggagctgctggtccccattaccacaagatatgcattctttctctttgataaggaattaaggtgccatattcaaactttaatctgtaaatacaggtaaataaaacatgattacagaaatcattttcaataaaaatccatcttgagcttaagtttctgccttactgaattcaacttttgagagtgggtggttgtgcctgctgcagataattgtgaccctgaatagctggaactgtgttcactgtgaaccaatgtttcctctgagagccccaaagaccctgagtgtgaatcgcttgagtgggtggggtctcttaccctgtgagtcctcccaccaggggccccatccttccacccatctttcctcgggcctgtttcccttgaggtctgagctggggtgcccagtgaggggtcatccttgctgtgagataaaaccgaggtgtgactccccatctccatgcagggccctagagggtgtgcgcagcttcaaccatctgatcaagggtggattcaactccctgctcagggcagcagctcgtggttcattcagctccagcgacgtctcgatggggataaggtaaggggcacagagaaccaaagattgggtctgatgggattaaacccccaactggtgtccctgtgtcttctctttcctgacaccagacgccaagaagaaagagccacaaacacacctgtcagtgaattccaaagggtgagctgggggccaggcggcctctgaagtctccacatgggttttgagcttttgcttttttgaagcagcaaatctgctctgggctaggaattggtgtttgctaaatgcacaggtggtctggagtgatgttttccttctttagcaaagtaacacatgctccttacagagagttagacatgcaaagaggcaggcatgttttttaaggataagttaaacattcaacaggttctcgggcactgaatgaaaggtgtccccgcaagtcagcccctcagccccccagtttcttcttggagaagccagtgcagggctccgcgttgggggccagtgggtaggaggctatctcaagacaccaggaggcgattagagggtctcagtccattttgatacctgtgctcgggggttgttggcttggactggactcctggcagcacccagtgagaaagggacaaatcaggctgtgactctggccgttttctcctctgcgactatgattcctttgctgcaccccctctttctggcccatccacagagcacagacctgtccttgctggctgacatttccctgctccctgaggcctggtgtgtaccctggggatgctcagagagtgtccctggattgatttcagggccctcacttcttggaggagatgtcattccctgcagagctccattcacctgctctgagcactcctcatcctgcccaaggacgtgctctctggtttggctggaaagaatgaccccaccatgccaactctgggattcaggcaaatcagagctgctcagcccaggctgcgttgtccagctggcccaggtgtttgtactgaaacacagctgtgtgcccactggttggtgcagagatgctgtctctatccmtatggagaccccgtactggcaccccaagatacagcagcacaaggggcacaattgctggcccagcagaaacctgaggaccccacactcgagctacggtcagtgtccacgatgactggccagccaccaagtgaacaaggacagaggcgtgggcagacgtgctgtggcctctcagtactgggtgtgtgagtggccagagagggggtctagatgccccaggtgtcttcacacccagaccagggtttgccagaccctgatggccctgagagtcctgaccagacccccgaaggccaacccaacatgctgggaatgaccatcggtgccaagcgggccttggacagctggggaagggctgtcacctcaaatgtcccactacctggctcctcctctttcctcagggacccgaatctgcccgctgggcacaggtcctcacacaaaggctggtccaggaaaaacaggaccacattgccaggcggcctgtccttcccctccccacaatctgtgctctaattacagaaatgacgggctcatggccagagacgccaagtaacagagaaagagaataaagtagaaaataagaatcattccccaacctacccccacacggagctgcgttttaaataactaagctccttgattgtgtctgtgtggaggcctgagttcctataaccgaggctgttttctcttttttttttttttttttttttgagacagagtctcactttctcacccaggctggagtgcagctgcccgatattgtgacctctacctcctgggttcaagtgattcttgtgcctcagctgggcaccaccatgcctgctcatttttgtatttttagtagagacgggggtttcaccatgttggccaggctggtctagaactcctgacctcaggtcatctgcccacctcagcctcccaaactgctgggattacaggcatgagccaccgtgcccggccttgtctgttttctcttcatgagtgcccggtgtcaacgggagaagcagcactggcctgagcctctaagccaaagcgtccgggcacagctggggacaggcaacatggacccggtcactgtggtcctaatggtagattgtggtcctgttggcataggcggctcatcacgatttcacctgtagctgctttatggaaggtctgaattggataggagcagaaaacagcttcattgttctctagccgctgcattccagcagcttctgtgaggcaggggccagattagggtgagtgagtgaggccaagtcatgcaaatacagggtcaaattgtgtcttagttgaaatgttgataactttcccattagggtttttttttttttttttgcattgaatttaacttttgaaaaaaattctgcactaaaatattatttattttgatccgtgaattttttggtgcccccttaaattttatgcctcatttgctgcatcctgataatccagagatgagcgcctccctcccctgcctcgccctagtccccatcctgctgataggtctctggtctctgctccttgatgacatctggggaagttttcctaggattttggtcaccttgatttataatagcagacttgctaataatgagtggaatatggccaggcgccggctcatgtctgtaatcccagcactttgggaggccaaggtgggcagatcacttgaggtcaggagttcgagaccagcatggtcaacatggtgaaaccctgtctctactgaaaatacaaagattagctgggcctagtgatgggtgcccgtaatcccagctactcaggaggctgaggcaggagaatcacttgaacctgggaggcggaggctgcagtgagctgagatcatgccactgcactccagcctgggagacagagcaagactctgtctcaaaaaaaacaaaaacaaaaatgaatggaatagctcatgtttcggtgttacaaaatccaggccagacaagtctcaactttaatctcacgcccagttcctaggttagtcccttctccagctcaaattcagcctaagcctcaggggtccttggtcggggtggcaccacctgctcccttccccaactttgttcctgtttttaatctgctggggctgggtgcattcagaggtagggacaggctgaaggtcttcagctttttggttctgttgatgggtgagttccaaatactagctttctcttgtaggatatttcatttatttgttaaaaatatttatttagaacacaccattcatgtgccagacgctattccagccactggggatagggtgataaatgagataaacaaaaatactcgcccacgttaagctcctattctagggaagagaggaaaaaaaagaaaatacatgtgtacttagtacattagaaggttccaagtactgttaaaaaaaataaagcaggctggactcagtgactcatgtctgcaatcccagcattttgggaggcagaggtgggcagattgcttgagctcaggagttcgagaccagcctgggcaacacaacaaaaccccgtctctacaaaacaaaaacaaaacatttagctgggtgtggtggcatgtgcctgtcatcccagctactgaggaggctgaagtgggaggactgcttgagcctgggatgcagaggttggagtaagccaagatcacaacattgcactccagcctgggtgacagagtcagaccctgtctcaaagaaaaaaaaaaaaaaaaaacaggaaaaagaaagcagagatggggactagtggkgagggggctggggatgakakyctccctgagcttccacagttcttyctgctcctctcctatctcactgggcacgggccacctggggcttctggttgttttgtgccaacttaatatgttgttcttgccaacagtcagaggccaactgaggcttctctgtcttccacaaggaacagcattggcctaaacctgcaggcaccattgcaaaggggagtcagctcaggtaaacccgctggtgaaacatgattccagcgtggggacacagaggctgatgtatcttgctgtaggtgatttaatgttgggcctcactatttcactacccctgtaagagtatgacacatccacgtccttaccagggcccgagggagggtggatagacttatccatcccataggtattgctcgtggctgggtaacttgcttatgccaacaagattttttcatagacacggcacaggcagaagcctggaatgtgttggcactgccaggcctgccctctaatgctcttgatttttcccacgagacgagcgtgccccagggaacttcggctccagctgcaggatgagaggcgtgtggagcacgcagggttccaaccctcagcctggagtcaagcccagactagatcagcctaagcccagccaagccacaggtgcaggagtgaaaagcaaatgctaactgtccatgacattgactttcaaaggggcatgtcatgttatgtggctcatcccagcaacaatgaagatatttctccatcagtcagtcggtgaataattattgacaatgtgctaggaaggtggagtgattggagtagatttggtccctattctcatggagcttactttctagaggggaagacagatgataggtgaataaatataaattattctattaggttgatgcagcagtaattccggcttttgccagtaaaggtaatggcaatcaaaagcgggaggagccggagctgccattcattaaaagcaatgacaaaactgtgatgacttttgcaccaacctaatagaataaattacgagtgcgcaaaacgctgtgatgggaaagttccaagtgccaggatagcatctagcttcctggagtcaggagatgggggttttcaacctaagcaaggttaagtccaagtggtgggggcaggcggggggcgatatttcaggggagactccaaggatgaatggaaattagaaaagtgaacgcagatggtgaggggggacgggtttcaggcacagagaacagcatgtgcaaaggcctggggggaggacatcgtgtgttcatggactgaggggcggccagcaggctggagctgagccggtggagaggaggatggggagccggggaaaggcgctccatgcagggggcacagcaggggcaaaggcccggagtcaggcctgaacctgtgtggtttgaggaagtgacagaggcctgtctgggaggaaagtaacagcagaggggagaccataaggtcagggcagagggcagggccgtgctgggcactgtgggctgtggataggacctggcacgtatgctcgggtgaggggaacgtgttagaagattttaagaagggcaggaacatctggggataatgtgtattctaggaatctcaaccaagtaaattcatagtttgaatgttcacaagacttctgcacaggcaaagtgaaagatcgtttctagagctgtgagataagatcatagtaaaaaagaactactaagtttttaaaggttatttcaaatgatggatttccatcttacaaatgaatgcaagtaggttgcaaggttgatggaaagtagaaaagttttctgacttgcgtgaacagaaaagaaacatcaatttgaaaggaaaacatttatttatttacttcctctacagttttcctgactgctacatttcatgagaagggattgtttatgagggtcaaggagctggaggcctggggaggagctggtgtttctgttcaagtttgagggtcctggagctggagtccaggggaggagccggtgctgccactgatgtcttagggtcgtggagctgaagatcccagaggagccggtgctgctattctagcttgagtttcgtggagctggagacccagggagaagatggtgctgctgttctaatttaaggatcgtgaaacagaagacccagaaaggagctggtgctgccgctgctcagatctgagggtgttggagctggagcctgggggtggagccgttgctgcctttgaagtctgagagtcattgagctggaagtccaggaagcagctggtgctgctgttctagtttgagggtcgtggagcgcagacccaggcagaagcaacattgctgtagttcgagggtcagaaagctggcgacccagggaggagaggtcttgttctagtttcagggtcgtggagctgccaaaccaggtaggagcaattttgttgtaattcgaaggtcaggaagctggagacccagggaggacaggtcttgttctggtctgagggttgtggagctgcagacccagggaggagcaatgttgttgtaattcgagggtccggcagctggcaacccggggaggagaagtcttgttggagtttgagggtcgtggagctgccgacccagggaggagctattttgttgtagttcgagggtctggaagctggtgacccagggaggagaggtcttgatctggtctgagggtcgtggagctacagacccagggaggagcaatgttgtaattcaagagtccggtagctgacaaccggcggaagagaagtcttgttcgagtttgagggtcgtggagctgcagacccagggaggagcaattttgttgtagttcgagggtcaggaagctggcgacccagggaggagaggtcttgttctggtttgagggtcgtggagccgcagacccagggaggagcaatgttgatgtaagttgagggtccggtagctggcaacctggggaggagaagtcttgttcgagtttgagggtcgtggagctgccgacccagggaggagcaattttgttgtcgttcgagtgtcaggaagctggcgactcaggtaggagaaattttgttctagtttcagggttgtggagctgcagacccagggaggagcaaggttgttgtaattcgagggtcaggaagctggcgacccagggaggagaggtcttgttctggtctgagggtcatggacctgcagacccagggaggagcagtgttgttgtagtttgaaggtcaggaagctggcggcccagggaggagaggtcttgttctagtttgagggtcgtggagctgccgacgcagggaggagcaatgttgttgtaatttgagggtccggaagctggcaacccaaggaggagaagtcttgttcgagtttgagggttgtggagcagccgacccagggaggagcaattttgttgtagtttgagggtccagaagctgacgacccagggaggagaggtcttgttgtagtttgagggtcgtggagctgctgacccagggaggagcaatttggttgtagttcgagggtccggaagctgacaacccagggaggagaggtcttgttttagcttgagggttgtggagctgccgacccaggcaggagcaacgttgttgtaattcgagggtccggaagctggcgacccagggaggagaggtcttgttctagtttgagggtcgtggagctgcagacccagggaggagcaattttgttgtagttcgagggtcaggaagctggcgacccagggaggagaggtcttgttctggtctgagggtcgtggagctgctgacccagggaggagcaattttgttgttattcgagggtcaggaagctggcgacccagggaggagaggtcttgttctagtttgatgttcgtggagctgcagacccaggcaggagcaacgttgttgcaattcgaggatccggaagctggagacttagggaggagmcgtcttgttctagtttcagggtcgtggagmtgcagactgaggcaggagcattgttgtatagtggaggtcagaaagctggcgacccagggaggagaggtcttgttgtggtctgagggtcgtggagctgctgacccagggaggagcaattttgttgtagttcgagggtcaggaagctggcgacccagggaggagaggtcttgttctagattgatttttgtggagctgaggacccaggcaggagcaaggttgttgcaatttgaggatcgggaagctggagacttagggaggagacgtcttgttctagtttcagggtcgtggagctgcagactgaggcaggagcattattgttatagttggagggtcagaaagctggcgacccagggaggagaggtcttgttgtggtctgagggtcgtggagctgctgacccagggaggagcaattttgttgtagttcgagggtctggaagctggcgacccagggaggagaggtcttgttctagattgatttttgtggagctgaagacccaggcaggagcaaagttgttgcaattcgaggatctggaagctgcagacttagggaggagacgtgttgttctagtttcagggtcatggagctgcagactgaggcaggagcattgttgttatagttcgagggtcagaaagctggcgacccagggaggagaggtcttgttgtggtctgagggtcgtggagctgctgacgcagggaggagcaattttgttgtagttcgagggtcaggaagctggcgacccagggaggagaggtcttcttctggtgtgagggtcgtggagctgcagacccagggaggagcaattttgttgtagtttgagggtctggaagctggcgaccccgggagaggtcttgtactagtctgagggtcgtggagctgcagacccagggaggggcaatgttgttgtaattcgaggttctggcagctggcaactcggggaggagaagtgttgttggagtttgagggtcatggagctgccaacccagggaggagcaattttgttgtagttcaagggtccggaagctggtgacccagggaggagaggtcttgatctggtctgagggtcgtggagctacagacccagggaggagcaatgttgttgtagttcgagggtccggtagctggcaacccggggaagagaagtcttgttcgagtttgagggtcgtggagctgcagacccagggaggagcaattttgttgtagttcgagggtcaggaagctggcgacccagggaggagaggtcttgttctggtctgagggtcatggagctgctgtcccagggaggagcaattttgttgttattcgagggtcaggaagctggcgacccagggaggagaggtcttgttctagtttgatgttggtggagctgcagacccaggcaggaggaacgttgctgtagttcgagggtcagaaagctggcgatgcagggagaggtcttgttgtggtctgagggtcgtggagctgccgacccagggaggagcaattttgttgtagttcgagggtcaggaagctggcgacccagggaggagaggtcttgttctagattgatttttgtggagctgaagacccaggcaggagcaaggttgttgcaattcgaggatccggaagctggagacttagggaggagaggtcttgttctagattgatttttgtggagctgaagacccaggcaggagcaacgttgttgcaattcgaggatccggaagctggagacttagggaggagacgtcttgttctagtttcagggtcgtggagctgcagactgaggcaggagcattgttgttatagttcgagggtcagaaagctggcgacccagggaggagaggtcttcttctggtctgagggtcgtggagctgcagacccagggaggagcaattttgttgtagttcgagggtcaggaagctggcgacccagggaggagaggtcttcttctggtgtgagggtcgtggagctgcagacgcagggaggagcaattttgttgtagttcgacggtcaggaagctggcgacccagggagaggtcttgtactagtctgagggtcgtggagctgcagacccagggaggggcaatgttgttgtaattcgagggtctggcagctggcaactcggggaggagaagtcttgttggagtttgagggtcgtggagctgccaacccagggaggagcaattttgttgtagttcaagggtccggaagctggcgacccagggaggagaggtcttgttctattgtgggggtcgtggagctgccgacccagggaggagcaattttgttgtaatttgagggtccggaagctggcgacccagggaggagaggtcttgatccggtctgagggtcgtggagctacagacccagggtggagcaatgttgttgtagttcgagggtctggtagctggcaacttggggaagacaagtcttgttcgagttcgagggtcgtggagctgcagacccagggaggagccattttgttgtagttcaagggtccggaaactggcgacccagggaggagaggtcttgttctagtttcagggtcgtggagctgctgacccagggaggagcattgttgttttagttcgagggtcaggaagctggcgacccagggaggagaggtcttgttctggtttgagggtcgtggagccgcagacccagggaggagcaatgttgatgtaagttgagggtccggtagctggcaacctggggaggagaagtcttgctcgagtttgagggtcgtggagctgccgacccagggaggagcaattttgttgtcgttcgagtgtcaggaagctggcgactcaggtaggagaaattttgttctagtttcagggttgtggagctgcagacccagggaggagcaaggttgttgtaattcgagggtcaggaagctggcgacccagggaggagaggtcttgttctggtctgagggtcatggacctgcagacccagggaggagcagtgttgttgtagtttgaaggtcaggaagctggcggcccagggaggagaggtctgtyctagtttgagggtcgtggagctgcagaccgaggtaggaacaatattattgtagtttgagggtcctggagctgcagacccagggaggagccatgttggtttgaatgttgtggatctggagatccacggaggagctggtgctgcctttgaagtctgagagtcacttagctggagatccagagaggaaccggtgttgctgttctagtctgaacagatctagagttctggggagttgccggttctgcctctcaagtctgagagttgttgagctggagattcagggaggagcctgtgttgctgttttagtttgagggtcatggagctgcagactcagggaggaggggtgcggttctagtctgagggttgtggagcttgagacacagggaggagctggtgctgctgttgtttaaggctgagggttgtggtgctggagacccaggtaagagctggtgctgctgttgtttaaggctgagggttgtgtagctggagagtggggaggaggtagtcttagtgtctaatgtgakgttggtggagctgtggacctggggtggggccggtgctactgtgtagtttgagggtcatggaactggagacctagggaggagctggtgctaccaccatttaagtcagagggtcatggatttggagctttggggaacagcccatgctgctgtttaactgtggggaggatctgctgtgtccgttgaagtttgagggtttgggagctggagacccagggaggagctgatgatgccattctattttgagggtcgtggatctggggacctggggagaggctggtactgctgttgtagtttgaggttcgtggaactggagacagggggaggagccggtggtgctgttcatgtctgagggttgtagagctggagacccagggagaagcccgtactacagctttttaagtctgagggtcgtggagcctgagacctggggaggggccagtgctgctgttcaaatggctcctttccgggtctccagctccatgaccttcaaactaggagagcagcagcagctcctcccgcggtcttccagctccatgaccctcacactagaacagcagcagcagctcctcccggggtcttccagctccatgaccctcacactagaacagcagcaccggctccaccctgggtctccagatccacgaccctcaaagtagaacagcagcactgactcctccccgggtctccagctctacaaccctcagacttgaggagctggagactcggggaggagccagggctgcttttctactttgagggttgtggagctggagacccaagatgcagcagctgctgctattctagtttgagggccttggagccagaaactttgtgaggagccggtgctgcctttcaaatctgagagtcattgagctggagacccagggaggaaccggtgttgctgttctagcctgacagtagtgaagctggagacccaaggaggagccggtgctattgttcatgtctgaggattgtgtagctggagacccagggaggagtcggagctgctgatctagtttgaaggctgtggagctgcagatcccaggaagagccggtgctgccgttcaaatctgtgggtcttggagttggagccctggggtgacccagttctttcattcatgtcttaggatcatggaactggaaacctacggaggcggcggtactgctgttctagtttaaggatcgtgaagctggagacctggacaggagctggtgctaccgctgttcaaatctgagggtcatggagctggagtcttggggaggtgccggtgctgcctctcaagtctgagggttgttgagctggagattcagggaggagccggtgttgctgttgttgttggaggattgtggagctggaggccaaagaggagctggtgttgcagttcaattttgacggtcgtgtagctggagacctagggaggagctggtgctaccactgtgtaagttgaggtttgcagagctggtggccacggggaagagccagtgctatagctgaagtttgagggaactggagacccagggagtagccggtgctgctttctagtttgagggttgtggagctggaggcttggtggggagccggtgctgcctcccaagtctgagagtcattgagctggagatccacaggggagctggtgctgctgttgtagtttgaggattgtggagctggagacccggggcggagctggtgctgcagttggagtttgagggtcagggagctggagatctggggagcggccagtacagctgtttaagcctgagggtcgtggagctaaacatggagccaaagttggggaagcagagagagagagttacaggatgaccctggaaatggtagacgtagctgtaccccaagcaagctaagcttgggaactcctcaatgctagtgatgaatgcattctttttcctcttacacagtttggatttgttttctgtgtctcatgagacagaaagatcttgattaatacccttaggaattgaaaagcttaaaaaactaaaggatgttggtaataaaaataataagaattaaaccatgattatcctggctgacagagacaaaatcacacacacacaatatatatctttcaatcagttagcaaaattaaaaaaaatggaaaaatagacgcaagcaaagctataaaaagttgtttcatggagaagcgatggaggacagcgattaatctgagagttgctattaatggagaaactgagaacttaccatttttcccatgaggttttggtgtagaatgatattgtgtgagttctggcagctgagtcacttcacacagcccggtgatgcagtaggtgtcacagaaggaccctctcccagttagttctgcctcactgctccggtgagtgcggcctctgatccccaacagctgactgtgtgttgagaccacgcccatgagcacaagggtttccacggtgaaggttcctggatggaacactgtggatgtccctaatgttccttcctgatgttcatctgccatcttgctatttaatgcaatgtcttctaaatattgaatagaaaaaagtatttgtacaatatgggcaaggtataaagaatatccacacactggacacacagacagagaggggcacccacagcaaactccctttgcctgggagcaggtgtggtccttgagtcctatgttgcctgtttcttcctccgccttggcctacgggcccgatgtgatctgacctctgcctgcctctccgactccatcccccctcccgctcctgttctttctaacaattatgttacagcctcagtgaatgtgacaaggaccctgaatgacggtggctttactaagacagaggttcattcctttcacatgaaagtccaagccagtcgggtcattcttctctgtgcatttttcagggtcttaggctacttccatcttgctgctctgacttccttagggtatagcttcccccacagtgtccatcctatctactgccagccagcagggaggggagaagagaacaagaggacacaaatcttccttcctctaatggcagttgctgtgcactggcctcatgtgcattggtcactgcctggtcacgtggcctctgcttgctgctaggggtgctgggaagttttcatcctggatgccarwgcccacctgggtgactcctgaggttgaggggagagaggacatgaaagagagtcactggctcttcccaccatcatgcatgtcgttccagtctagggcgacccactgcctcagcttgctcaggactgaggagggtcatggggcacagacctctcagttttataacagggcagtttcaggcaaatcatcccagcttggctgagactcagaattttcctgggatatgggatttctagtgttaaaactgagaaagttctgggcaaacctggacaagttggtgcctgccatggggcctttgcatctactgttacccctgtctgggattccctttctgcagctctgtgtggtgctcactccttttctgttgaggaaaggctgctctctgggtgtccccgggtgcctgttccgctctactcagcactacatgctctgtgaatatccctccatgcacttcgtagaatgagatctgttctttccacccttgcctgcccacttcagtttcaaagtctctgaggattattcatttttattctcttcagcactgaaagatacatctctttccctaaggctgtggctgggttcacgcatagttagataaatctgatattaataataacccgaatgaaaaacatgtattgaatcccaagattatgatgtaggaagcacggattctgaagagatgtctaagcctaataaaggccaaagggtgtggattaaaaggaaatgtggggtggagaaacatttcatgaaatagaaccccacctcttgggtgagttcgttggtacaacttttctagagggcaattttgcaactggccaatgaaggtgcgtaacttttggtcccaaatttcatttataggcattgatccctaggaaatagtcagaaaaatatgcaaagatgaatctcaaggatttttataagaagaaagaagtaggaagcataaatgcccactggtggtcccacaccctggcaccagtgctcccctctcctagtgggcgggcacaggctacattttcccaggcttccttgcagtgagttgtggccatgtgaccaggttctggccaatgggaggcaataaaagtgttgggtggtatttttggagacccccttctgtaacttctgtcttgatatggtttggatgttggtcccctccaaatctcatgttgaaatgtgatccctgatgttggaggtggggcctggtgggaggtgttttggtgatgtgggcagatccctctcacaatggcttggtgccatcctgatggcaatgactgaattcttgctctgagtttatgggagatctggttgtttaaaggggttggcacatcctcctccctctcttgctctttctctcgccatgtgatgtacctgcttccctttcaccttctgccatgattggaagcttcctgaggcctccccaggagcagatgctggtgccatgcttgtacagcctgcagaactgtgagccaattaaacctctcttctataaataaccagcctcaggtattcctttatagcaacgcagatggactgacacatatctttaatgtcatttcttagttgttccatcctttgacctgcttcctggaataagcgtatgatggttggagctattcttgtcaccttgaaccttgaggattaggcttctaccctgcggatagcagaatgtcctctggaaggaaatgaaagtccctaacgccaccctagactgagaacctccagttttgttttkacttttkkatkttttgagacagactcttgctctgttgcccaggctggaatgcaatggcgtgatctcagctcactgcaacttccgcttcctgggttcaagtgattctcatgcctcagcctcccgaatagctgggattaccggtccgtgccaccatattcagctaattttttttatttttagtagagacagggtttcaccatgttgagcaggctagtctcgaactcatgacctcaagtgaaacacctcagcctcccaaagtgctgggattacaggcgtgagcctctgtgcccggcccagtcttggttttcatgagataaacttctgtcttggctgaagttaaatcactgataggtgatatgaccataactggataaaaagtaggaaattcatgtaatacttatatctacatatgcccataccaaaaatgatagtgatctgttgttatctatgtgtaaatatggacacaaaatattgtttagtgtaaacaaagctcttcttttttttttttttttgagacagagtctcactctgttgtgcaggctggagtgcaatggtgagatctcggctcactgcaacttccgcctcctgggttcaaacaattctcctgcctcagccttctgagtagctgagattacaggcacatgcaccacatccagctatttttttgtatttttagtagagctagggtttcaccatgttgtccaagctggtctcaaactcctgaccttcagtgatctgcctgtgtttacaggcatgaaccactgcacctggcccataaagctgtattctattttaatgaagcaaaaatgcataagtgtgtaagtgtgatcatatgtgtgtgtatgtctaacaggagcactacatagcaaaatgcgaatgctgcttatctttggtgttggtatcacgtgtgatttaaaatcttgttttcttctatttttaaaaactttcaaaatgagtcatgactttgattattagaaaagaaatctataacaattgagaggaaagaaaaccccacctgttgttgaaactggctggagctgggagaaatgagagattcctttgcaggtgtcacctccctaccagaaaactggccttgcaggaatgtcccacaagccagatgtgtctctttcccccagtccctgtgcctggtgtgaggtcgtacagacagtgagcgtccttcacagagtctgacctgccaaggtaggggggaagtgggggtttagtgacattcaaaacccgggggagccgaacaggtgtgactgtatgtttgcagggtgacctctcccctcaaagagcaagaaataactctagtgcaatttccaaacatttacaagagaggatttttaaacttttcacttctttattccaagtagcacatttggaagcacaaaatgcacaaagaagacctgctatttacaatcactttcactaagccagtgttatattcaaaaacagcagataaagctcatggctttgatgaaaggggcagtcttttcattggaaacaattaatactgctccccgttctggggagaatttaaagaaaataatttggaaggggatatggcttgatacaatcaaatgatttcagatcacaaatgtaatcatttgatcttgctttaaaaccaaacatttcagaacaatctggcatcacattctcttctgagtctgtgaaactctgaattctgggtgagtttgaattcccaaggcaggactgaggatagaaaagatttgatggcagaaacctggtactgtggttatcacgtgggttaaagatgtaggcttggttaacccactgaacctgcttatgtatgaggctcacctgagaaggtgatatggacaagcccatcttatgggtctgagggctcttcaccaggagtggagcaaggaggatggccccagcgtccccgtctctgaacacgtttagcgggagggctgtagagcctggacagatcaccactggctccatggggaactttcagcagcactcattgcctgtgtctgttctgtgccaggcactgcgctcagggcagggatttgggattcaccagggcacaaggcgacgtgcgtctgtcctcacggagcctaagtgctggtggagacggacagtgcagatgccaaccgcaaatgacgaggcacttgcaggtaggggtcagcgccaagaaggaaatgaagggtgcgtgtcgctgactgagactctggtgggggctacttaaatagggccatgggggagggcctctctgaggaggtgacatttgagctgaggcctcaccaatcagaaggaaaaagctgtaaagggtctgggattaactcaacctggggacttttaaaataatgtaaggtgttccagctctttcagaatttgtctagcacgttttccggttgtcactcccaggtgggctcgggaagaggcatctgtgcccagctcgtggcctgttctttgtacttgcggggaaggggtccccttctcccacagccatccccccggggcctgctcccaggtggggtctggttttcaccagaaagccctccatgcaaaaacaacaacaacaaaaaaacaccaccacaaaattgaatttgaattagttgccagcatttacattttaattctaaaaatctgtattttcgacttcgttggaaagtcagactatctggccatgctgggctgggatctggtggattttggtattttggtttctggttagggagggtatttggggtttgcccctccagcatgtgttccagtgtggagtggggatgggggcaggctcagtggggggatctgcagtggccaagggtcttggctgtctccagatggccggacggaccctgccacctcctgcttggggtgtgctggggttctttgctgcccctcctcccagcccacatcctcttgaactccacggagaccacctccatgtgaggctgggaagggaaacctgcctttgtaagtggaatcaggtgaaatcgggctgtgactgtgtcagtcagaaactaaaaggccctgtcacacccgtggccaggaagactgtcaccacggtggcatgcaaatgacagagatgcgtgggacagtgtctaccaagagacgagccaggtgagggcaggtcgtcgtgaaggagggaggtggggtcctccccacagagcagcgccatcccacagagaaacggcctctggggagggacgcgttccaaggaggccccgtgcagtgcagagtgggtggctcgaggcctgaatgccgggcactcggagcggtcagtgtccccgtgggaacagggctgctcgcagccaggtgattggcaaccttggatggtcagcccctgtgtgcgtgtgagggggtggccctctgctctgtcccttctgaaggcagctgtaagggctgggatctagtggattttggtatttcggtttctggttagggagggtatttggggtttgcctctccaggatctgtcccagtgtggagtggggagcagccataagggatggaggccaaagcgctcagcatcagacaagcctgggcgaaggtcctacttcctgccaggccagtgcctctgagcctcagtttcctcatctgtatagtggggttaatcccaaccatgtatactgcctgcctgccatgtgccaggcccttcttacacatctttgattgcttgagggcagggactttattatccacctttagagttgagaaagaagaggcatagaaaggttaaaccacttaccgggggtcacacagctgctgttgcagagtaaagtctccagactcaaacagagcactaagccccgccctgcgcaccaacaggtgctccaggaatgtcaggtgccatttatcaccctcatcacctgctgggagtgctcgtcccatcattcaaaccccgtgagcgtgaagtgaggggacatatgcaggatcgagtgtactggcaggtaacgtaagtaaagtaataaccacaggatgatattcacaacccatattagtgctaccaacagccacatctgcctgcttctctgggcccaggattgtctgcaggctcccaggagctggtcctgactgggtcagaagaaaggtctgaggttatgagaaggagtagcttgcccagctcatggcctgttttgtacattgggagtccctgtcccccacagctgtccccatgggcctactcccaggtgggcttgggagaccccagagctgcgcgcctttaggccagggttctgccgggtgctgggtgtctgtgggggtctcgcccaccccccaaccctcttgccctgccagctgctggacacacagcaactgcagggcatgaactctgagaccaggacctctgcaggtcctgggaggcagaagttgcagtgaaccaagattgcaccattgcactccagcctgggtgacaaagcgagactctgtctcaaaaaagagaaacagatatttatatgagacagtctgtagaggtttgaaatgcaacatgatccatcatgcggagatttttatagagaattaattgtttcagttcagtgtgaagggacttaaactcctctcttcactagaattttccaaactgttaaggggacatatgtaattgtcacctgcatcacatgcaatcaggggcccataagaagaagtgaaacgttcctttcttacatgattgtttttggtgaattgagcagttttgtattcatcattcaaaatgcacaggccaggggaatgcccaatacttctggctgcctaccctcccactgcaactaacgtaagcaggcaagcaatggctgttgataaggacacaacggtcatcatcacatttcaggggtttttgtttgtgtttgtgtgtgtgtgtgtgtgtgtgtgtgtgtgtgtgtgtgtgtgtatttgtttgttttgagacgaagtctcactctgttgcccaggctggagtgcagtagcaaaatctcagctcactgcaaccttagcctcccaggttcaagcaattattgtgcctcagtctccccgagtagctgggattacaggtgcccgccaccacacccagctaatttatgtaattttagtagcgacgggatttcgctatgttggccaggctggtcttcaactcatggcctcaagtgatctgcccacttcggcctctcaaagtgctgggattacaggtgtgagccaaaatttcagggttgtttgtttgtttgtctttaagacaggcgctctctctgttgcccaggctgaatgccgtggtgtgatcatggcccactgcagcctgaacctcctgggctcaagcgatcctcttgcctcgctctcctgagtagctgtgaatacaggcgcatgccaccatgcccggctaatttttgtattttttatagagatacggccttgccctgttgcctgggctggtctcaaactcctgggctcaagcgatccgcccacctcggcctcccaaagtgttggaattacagacatttcagtgtttttaaaaaatcaaaaaagcatgactggatacaatcaggatttcagtagaagtagaaaatatgggaatgtcagtgagcaaataagtgcagagagaacaggggatgagaagaggaatgtgggaagatgggaagcgctgggcggagaagaggatggggacgggctggggatgaagtctggagtgcaagctacagtcaggaaactgaaagctgcccaaagcattaagattgcccaagccagaagcacacgaggcagttttcaagagagtaaggagcaagagatcattaaactcactcaccaggagagacaagagatggtgggagtaatttaatgagagaggccttgacactacaaaaaaatctaaattcattctttgcctgactgttcacaagggaggagggggaagcggttgtcttcagaaaacatgatacatttttcttaggcaaaacttacagagaggaagagatgggaaaaagaagcaaccgaggtgatgggaaatggagctgatttattcttggtgttggagcggcagtttctctaacacagataaactttaaaaaccagctcagacccatcccttgagccctcgcttgtccctctccacaggtcccagcccgttcagagttttcaaggaagcagctcccaggctactgccaccttcctgggacctgtgagcccctcatcacccaagctggcagaatccctccaactcatggctccgtgaaacctgagtgcctgcctccgctgaccaattccctgggtggattttcttctggtggtcggaaaactgtatcagtcttttccagatgtctggcattacattctgtcatttggaatacagttgattcttgaacaatgtgggagttgggggcaccaaatcccacgcagtcaaaaatccacatataacttttgactctgcaaaaacttaactactgatagcctactgttgaccagaagccttactgataacataaacagttttcgtatgttaaatgtatcatatactgtattcctacaataaagtcggctagagcaaagaaaatgttattaagaaaatcatacggaagggagtatacatttactcttcattaagtggaagtgggtcaccatgaaggtcttcatccttgtctcttcacattgagtaggctgaggagtaggaggaggaagaggagggtttggtcttactgtctcggggtggcagaggcagaagaaaatctgcgtatatgtggtctctggcagttctaacctgtgctgttcaagggtccattgtatttattacccagtgggctgaaatcaagataaattaagcacaggtaagtcccatttcaagaagtccaatacatamaaatctgcccatagaatactcaaatgaaacaaccaaaagagacccaaggctcttttggatccaatktcctcaacactgaagaggagaatgtggccctctgagaggcattcagttggactcatgtgtagtgagaytgctgtttctttatctagggtctgggcacaggagcgtgtacctggtgaggattaattgaaatgtactcttatgatctgggcacgtttcttttcttcctctttctcttctcctcctcctcctcctcctcctaccccttcttcctcttcttttttttttttttttaagagatgaggtctgactatgttgcccaggctggtctcaaactcctgacctcaagtaatcaacccacctcagccccgcaaagtgctgggattacaggtgtgagccaccactcctggcctgggcacttttcttatgtatgctatcattcagtatcttttactcccagggggattttgattgaggaagagcaaggcattttttgttttgttttgtttttgagatggagtctcgctctgttgcccaggctggaatgcaatggcacgatctcggctcactgcaaccaacctcgtctcacttgtcctcccaaagttctggcattacaggcatgagacatcgtgcccggcctgagcaagacattctttaaaggtgagccacccccctgcgagggtgtttgagccactccctcaggaaccacccattcctggttctttcccacgggatttgctccagcctctgctgctctggcttccccagcttcccactcctggctcccctcctaccctcctgctttgtcacgtcccctccagatcccccaaggaccctggctgggctggctttcccatcccagagtcccctgtggcccccactgtcttggctcagggaagcctctttcccagacaggcccgtcctggccaccaccccaccctccatcccccagatggcacacgtacaagtccatcgcagaccccatcagagcccagatttctttggtgaagatgtgacttggcacagatgaacccactctcttgaaatttcatttctgggctgcataacccagcggcagggcacagctagcatccagaccccctgtaatgatttagagaaggaaaagaaatcttggacgggcgtggtggctcacacctgtaatcctagcacttcgggaggctgaggcaagtggatcacatgaggtcaggggttcaagaccagcctggccaatatggcaaaaccctgtctctactaaagatacaaaaattagccgaaagcggtggcacatgcctgtagtccaagctacatgggaggctgagacgggagaattgcttgaacccaggaggcggaggttgcagtgagccgagatcatgccattgcactccagcctgggtgacagagagaggctctgtcaaaaaagaaagaaagaaagaaatcttagagcccaggaagagaacaagaacaggcaaggcagacagtgactatcagtcttccccagtcagctttccaccctgcagcctccacggtctttctccatccagctccacgcatggtcactccactgcgtaaaaaccctccagctcctgaaatggaaaaatacacttccgaagcggcgtgctcccatcactaactcccccaaaaactcaccgtccacaccctgtgcatattcgatgttggctcttatctttaatttcctctccccattttatcttggcttatttagggttttttttttggttgtgttttgttttgttttttgttttttcctattttttgagaactcagtacttttaccatcgcccttttgaaaccctggagcaatacaagcatttaagactataaattttcttctgagtacagcactagccgagtccctcagatgctggtgtaaactattcttgttgttttctagaaaccatcattctagttttggtttctgctttgatctgggagttatctgggagagagttccttccccagtaaaaggcactgttctctgtcccattcaatgcgttttgacaaatgtgtctactcaagtaaacatcatcccaatcaagacacagagcattcctagcagggctatctttttttctatttatttatgtatttattgagacagagtctcactctgtcacccaggctggagtgcagtggcatgcgatctcagcttactacctttgtttcccgggctcaaatgagagctcccacctcagcctcctgagtagctgggaccacaggtgtgcacccccacatctggccatttttttgtatttttggtagaaatggggtttctccacgttggccaggctcgtctggaactcctgagctcaagtgatccacctgcctcagcctcccaaagtgctgggattacaggcatgagccaccacatctggccagggctatctctttaccatttattttaatgtcatttgtaatgatcagagcatggcctataatctttattttttaaattttgtaaaggtttcttttgtattcaaagaaacaaaagaaggaaataatttattaaaaattcttaagcatcaaatatcctcacccttgtgtacatttccagctctgtttccgtatcccttccatgaatttcctcttcactgcgctcctaacctggtctatccatccttaaactatagctctaatcatgccccaaacacaccccctctttcaatagattgtgagtagctgaagggtccgaggctgcatggtttccatctctgtgtctctgcagctagaccagtgctcaatgtggcagaggtgctccaccaacattcactgactacaggtgaattaaatacacctgtgccgtggggggacccaggcaggagggcaggtggttcagagaacacttcctgcagctgcagcctcatctctaccttggctccattcacagcgagatatttcagattcttcttcagagagcctgaataattaagggaaaacattctaacattcacctattggtttttctgccaagccccagtggcttgaaataagtaaatcatttaaaccatcccatccttgtgtctcggggaaggtggtgatagacagggaatcgatagattcaatcaggggagtgagaggcatgcggataaaggtccctggccagggcctgtctgcggccctcatggctggagatgcctcggaaatccaatcagggctcttcacaggggacatcaccgctgactgtcactgcattcttacccmtgagsyrgcmgagggtccctgccgagagacagggacacgtgggctcaggaaataaagactcaaagcctccacttaccccacacctcagcctccgagggatgcggggtcacctgctgggagggaggggcagaggccwcwctgggggtggcacatgggtgggacccggtcctgcctggctgaatgtcccccatgctttatctctttcmcaggccacctggattttaagagcactcacctgacgccctcatgccccagatttccagcccggcagcacccttgactgtggctgccaggctctgtgccatctggcccctgcctgctctcctcttccacctcctctgctttcctcctgtttcactggcttctctctgctacttttttttttttttttgagacagagtctcattttgttgctcaagctggagtgcagtggctcaatctcggctcagtgcaacctctgtctcccgggttaaagcgattctttcgcctcagcctcatgagtagctgggattataggtgtgtgccaccacaccaggctaatttttgtatttttcatagagactaaaaatagttagggtttcaccatgtgggccaggctggtctggaactcctggcctcaagtgatcctcctgcctcagcctcccaaagtgctgagatgataggcgtgagccaccacacccgggcttctgctacttctttgaaccagggcccccacctcctgtcaggcctgtgtgacgctagccccgctgcctggaactcccttctcccagccccgcaacagccctcctagctcaggaactcccagaggataaacatgagatgatttgacaaagcaaacggggctagcactaagatcgctgaatcctgtagtggttcttctccaattcttcagtcacctcaaagaaaacaccttgatttggtgctgatgcgcctttagctcctttccagaccttgcatttcatccttttgaacaaagaaaggacaggccccgggcttcctgcagaatgaagcccttctgtttaggtttattgcttttagttctacagtcatcatccttttgcatggaaaagatgctggttttctatttactctggtgatagagttttccttttgaattaaagtttcttaataaaaacaaaaatggagttgctaagcaacatacactgatgttagagttggcagaaatggccaaaggaccggggcatggatgaaatcacactcctgggttgctccaaaatgttcagtaaaatgtgtctctattagctacttggggatgtggaacttggagatgtgaaaagcagaagaagaagcccacgatgtggttggatggagggacccttgcagaagcaagaagggcagctgtgagatgcagagtggagaattcgaccttagcagaggccagaaaaaagagctgggaggagcaggaaaaatgtcagctctgtgaatggcagaaatcgtgacgatgatgattttggacatcccgtgcgctcaggatttaaacactggggttacaataagattctatggtcctttcaagccggaattgctggtcacatgaacaaatttacggggaaaataacagccacgggtaactcaggcaagtcaggtcccccaggctatggataaacagtcatgcctgagtcagcctctttcttgaatattttttttccagttacctgagccaataaatccacctttgccttagaccattggggtttaatttttcttcacttagcagctgaaagaatcttaacttacagaaaccacagaacatagacataattactcttccattttacagcagaggaaactgaggccccacctccttctatctttatcctcggatttttgagaccgttgccttctgcttcatcccagacatctgtaccctgttttctcccatccaaagagaaggaaaaaaagacaatgttcacaccccactggccatgttttggtcacaaggaggcctgggaaatgcagtctttattccaggcagctaggctcactgctaccaggagggatgctgaggtcatccagcagtctctgccacagctgggtaaccccagccctgtccctgtcccccatggggcagcttgagtgcaggacagaggacctgcaagccccacaccaacctgacagggcaccttcatcacatggcctggccaggtcatcctcacaggaggacagcactagggtctgggcaggaccaaggctctggacaggccagagagaaaggtatgagcagtgacgggagcaatatccaaaaaggccccacccctttcctgggtgcccagggaaccccagggtctccctcagtgctgctggctccttcctgcaccaggcacctgagacagaggctgcagtgagaagaccccgtggtcagtcactcttgcattggatgggaaactcctccctttgaatgaaatgctaattatagcctgcatgtgtgcagtctgttacctgctaaaaatatgctgtcttattcttgtctgcacaggtgcagctgagttgggggaaatcatgctgtttttagcactggtataagcagacaattgaatcctagactttggggacggggtctgcctgggaacttgtttccaggagtgtgactgaagtgaagggccagtcagaggaggtgccgcaaccccggggcacagcagagcagtgccaatgtgggaggaagcatcttccaacagtggtatcagcttcacagtggaggcagcctcagcttccagggctgagagacatttgtcatcttggcaggagggaggctgttaaaacaggcactgggggagcacaatggggccccaaatccacccaagaaagccccaaaacagggatgttggaatgagatgaggaggaaagggtcctgaagacagaggaggcaggtatggggaaggattgagagatgtcactcattcattcatccattcattcattctacaaatatttattgagtcctaccacatgccaggtactctgctaggtgctgggttgaaagggacagataaggtcgctgccctcatctttattacaataatatttctatacatattgagccaggaactgcccaaggcactagagacacacatcaaacaaaaaccccttcttggagcaaaaattctaatgggggaaggaggctctgatgtcccctctcccaagaacaaatgaacacggaaatgatgataagagttggggactcccatgggaccctcccgtccctgtccctgggtctccagttcagccttcgagagtccaggaggtgtcggctttcccacctggccacatctgctgctcggtttgtctcacatgctgctcaaagactcaaaccagcatcctcagccctgatgcaccccctcactctgggggggcacaatcacaggatgcaagtgagccagatatccagaaaggtgaagacctcctggatctagacaagagaatccaattggctgagccaaatttgcacacaacacctgcatgggaggcaggttctctgggttcaaatcccagcccactgcctaccacttactagctgtgtgaccttgggcaggttatttaaacctctctgtgcctgagtctcctcctctataaactgaggataatgatagttcctgttacataggattatcagacaagttaaggcagaaaataccagtaaagtgctcagtacaccatctgcccatgggatgcaagggtttaaaatgttaggcatcatcaccctcattacggttgcgttgaattttatattgattattggctttatattgattacttctgattattattgattggttttatattgagtattatatggcatctgataacattctcatgaccttccttcctggctccacagtgtcatgtgttttttatgctgggatcaattccattccctggatttgacatttccctgcagaaacgcaggctgggaagggagctctgaggtcatcccccatctttatcacaatcatcagccacagatgtccctgagtccagggcaggtgctggcccatcatcccgcaggtggttccactctatactctacagaacatgtgcttcccattccatcttccagcatctgctgaccctgaatggctccccagccttgccctggcctcccgtcctggtcatgagcagccccttccccacacagcagttagaaggatccttctcatgctgaatcagccctgggcagctctctgaccacaaccttccagtgtccccatcacgggactgatgggccaggccctgccccctctcagctcctgtctctgcccaagctcccctcacacctgccctcagtccctccagcctccctgctgtgtccaaccaccaccccctcttactcccagcttgtcccacctcagatccttctaccaggagtgaccttacttaaatatgcccaccctccactggctcctcctcatcagacaaggcaggtcaagtgacaccacctcaggagccctcccaactcccaagtccaatgtcggccacactctcccatctgtcatgtcactctcccttgcttcatgggtctaagatggctgccaaactccaaccatcacactgacattccagatagcaggaaagcacaaaagataaagaagagaatacctctgtctttaaggacacacccttaaagttgcacatgatgattttgcctactttcccactgtctaggactaagttcccttgccatgcttagctgcaaaggggctgggaaaggtagtcatgactctgggtgaccataggcacaactgatagtcagcagtagttctattactaaggaagaaggggaaacagctaatctgttagggaaccacttggactccctgccactgccacctactgactatttcaccttgggcaagttactggggatctttgttgtgaatctcagatttcacatctctgatatcaaatgcaaactcagaagatccagcctgttctgtcccctgtctgtccttgtggtcacacctctttccactcccccacctgattcactttgctcccagagcacaggactcctttgtctcaaatctgccaagctcattcctacccacagggcctccgcatttgctgttccctaagcatggaactctcttctgatcatttttcctaactgtggtaaattacacacataaattaaccaccttaaccatttctaagtgtacagctcagtggcattaactacattcacaccattgtgctacgatcaccaccatccctcaacagaacttttcatctggcaaaactgaaactctgtatccgttaaatacgactccattctccttcccctcagcccttggcggtcaccattccaccttgtctttataatctgactactctaggtacctcctataagtggaatcataccgtatttgtccttttgtgactggcttatttcgttcagcataaagtcctcaagcttcatccgtgttgcagcatgtgtcagaatctccttcctttctaaggctgagtaatattccatcgtagggatataccacattttctttatctattcatctgtcaatggacacgtggattgcttccgtcttttggacattgtaaataatactgctatgagcctgtgtgtacagatacctcttcaagtccttgctttcaattttttggggtatatacccagaaaggaatcgctggaccacatggtaattatatgtttaatgttccgaggaacagccatactgttttccatatgggtatacaattatacccccatggtatacccctatagtatacaattatacccccatggtaacccctatggtatacaattatacccccatggtatacccctatggtataattccatagggtatagccataggggtatacaattgacatttccatcaatagtgcacaagggttccagtttttccacaccgacaccaacacttgttagtttctgttttcttgatagtagacatcctaatgagcatgagatggtatctcattgtggtttgggtttgcatttttctaatgattagtggtgctgagcatcttttcttgtgtttatgggccatctgtatatcttctttggagaaatctttattcaagtcctttgctcattttataatagggttatttctttttttgttgttgagttgtaggagtttgtttttaatatcctggatattagccccttatatatatttcaaacattttctcccatttcataggttacctttcactctgctgtgtctttagatgcaaagtgtttaatattgctgtagtccaatgtatctattttttcttttgctgtctacacttttagtttcacattcaataaatcgttgccaaatccaatgtcatgaagcttctctcttatgttttattctaggagttttacagttttaggtttgtgtttaggttttttatccattttgagttaatttttatatatgataaaaggttcttttgtatgtagatatacagtttttgcaacaccatttgttgaagggactgttctttctccattgagcggtcttagcatctttgtcgaagatcatctgccctacatgtgagggtttaattctgggctgtctgtactgttcccttggtctacacacctatctttatgtcagtatgatactgttttgattactgtagctttgcagtaagttttgaaatcaggaagtgtgatgtctctaaccattcttctttttcaagattgttttggctatttgaggtgccttgaggttccatatgaattttagtataaatttttctatttccacaaaaaaattagaattttgataggggttgcattgaatctatagatcgctttggaaggtaagggcattttaccagtattaagtcctctgattcatgagcatcatctggtgtctgcatttatttgtgtctgctttaatttttcagcaatttttatagttttttatagtttttggtacaaatcttctgcctcttcaaatttattcctgtcttttattctttttgatgctatagtaaattgaattgttttcttaattttctttctgaattgttcatattcactgatttttgcacattgattttatatcctgcaacttgtcaaatccacttattagttctaacagggggatttgtagaatctttagggttttctgcatataagatcatgtcacttgagtacagagataattttacttcttcctttccaatttggatgccttttatttattgttcttgcctaattgctctgactaggagttccactgctatgttgaacagaagtgcttcttccactagttttcgctcagtagattccttctctgcattcgagtctcaactcaaatatgatctcctaacagacagcaatcccggacgctccctagtccccagtcccttgctatcacatcaacacactttattttccaccatttagtatgatctgaaattacactgtgtatttgtttaattgttcatttcctgttttgcttcctgcacgggggttccatgggtacagggacctgtccttcttgcatgccccatgcctaggatagggtctggcacaaagacattccttgataaatgtttgttgaatgaattggtcaaagatgggactgaggcaccagcagttgtaggctcccatgcccctggcaatgcttccttctctcaagagttttcttctctgcccgcccacaaaacgtcttcatccaaataggttgattccttgccatcctctacaattgctctgagcgactgcagtcggtcatctaagtggggatgcatagcagtggcccaggattagaggtgcagaggacatgcctttcttatcagggatagtcctaataacaatatcttatttacaactcacttcacagcctgcatgtacttaagcatctgccatccctgaaagagaaagataaacacaattgagacatttaggcagaaaatgaagggaagatgaaaaggtttaaaaatgagcaagggatgcattttccagcattgaatgagagcataggtttcttcctggtttcaagataaaagagaaaaacctgaaggagaaaaacactcaaaaaaggtgatgctttatcctgaagattagcccacagcagactgtcagggaatctatagtaacggagactctaggataaatttttttaaattaagaagcagaaggagaaaaggcagcagccctgagcctcgactttggaacgtcctccatccgtctgcgtctgtcatcagctggcagagtgggtgcatggcagggggagccagggccattgttcctcccctcagccctttctgctctcagtttagggataaccaatgtttgatggcttgtctctcaagagcgattagaagcaaagctgctcattacaggctaaatctcaaagcgctcctacagaaatctcacttcctaagcccaaagccctgatcccgggctgcattttgacaaggctcatctgtgaccctgaccggcaccagcggacgacgatgggctgacacacacagcacttactgcgggccggggactgcagttctgagctctccgggtgcatgaacttgcttaatcctcactgagctcaacgatgctattgggattcagctcacagatgaacagagccgggctgggcagaatcaatgctccctgggcccatggctgcaggacagcggagccacttccaggacccctggccagcaccaggcccacaccactgaccactgcccactgatggtgctcttgacagaaaaggggcctcagtgacagccctgataccaatattgctccagatgcctctttccaggaaaaagtcctcttctgagacagtgaatccagtgaaccagacttttccagggctctcagaattttggctgcattcccacagttagaagtgttggaaccaatttgttctaaagagagtgtggaaatctctatgaaagccaccagtcaccaccctaacatgaaagagggacattcgaaaggagatttctaggagggaattagcaggaggagacactttggcccaagacaaagagcagggcttcgagaaaccaccggcagaggctgggctactctccaagcaggacagcatctctcagactattcttcccccaagagtgctgggaacctccgagggcagaggggatgctggactggacccatctgggaaggggtccgctgagtgggggttccctaaggctttacatggggcaggaattgaaggtgaggtttgcaacaaggggtgcattcccagcgccccagtgtctgaaaagcatgcagtatggagccccagcgtgtttctgaatgctcctctcccaccgtcccatgcacctattttatgtcaggtaccgttgaagcagatcctgagaggaggaccttcatgcaaggactggatctaggatctgcaccagagaagacgagaaaggggtagggagaggggatcaggaagagcaggaagccgggccagggtgcggccttaagccaagccccttagggagggaggcaggcttcagcccaccctgcaggggaatccagcccagggtgtgagtcacagccactccttgtcctgcctcagggcagggagctgggcttccggacacctgcactccagacacaaccagctctctgttgaggcaaggcagatccaggagccccagggccatcctcttatgagagccagagctgtggcccatggaggggaaggaaggtacagccaccagggccaggcgatgaacacaaaatgcagaagagaatcccagggcacagaggctggcacccccgctggccgctccttatttctctgctcactgcctgtgggaccctcagcctgtcgcgcgccctccctgagcctgtttccccagctccagagtgagaatcgtcataactgccctgacctccaagggctgccataaaaccaggagaaactgtccagaaaacccagcacagctgggaccagcagcgggctcattaagaaagctaaatatgctaaagtgggtggggaatccaaaaaaaaaaaaaacccgtttacactcacagctttatacagttaaaagaaaacatgcaactctcctataattgacgaatattttcatgccagggctaatgactttcttcataatgtgggcctgctgttggattctcccattgtctttgttctttatataattctacaatgttcagttttggcttctttgaagtggaatgagggtatgaaaacacttgccacgcaatccgggtgcaggatccttccacaccagcattgtccagtagaaatagaatgtgaatcacaaacataatttaaaatgtttcagtaaccgcattaggaaaaaaaaactaaaaagaaacagaataaattaatttcaatgatatattttatttaacccaacatacctaaaatattatttcaacatacaataaatgtaaaaatgaaggtcatttacatttttcattctaagtcttcaaactctggtgtgagttttacccttccagtgcacctccatgtttatcagatatacttgacttctatttcgattttagaaatttgacagctgaaaaagtagattcacataaacaactatccccaaacatatttaaaagctttccaataactgaatcacatatcagtttttaatcatttaaattaattaaaattgaacaaaattaaaaattcaacttctcagtcacatcagccacatttttaaaaaatattttttaagttagagatggaggccgggcgcggtggctcaagcctgtaatcccagcactttgggaggctgaggcaggctgatcacctgaggttgtgaattcgagagcagcctgaccaacatggagaaaccctgtctctactaaaaaaaaaataaaaatacaaaaaattagctgggtgtggtggcacatgcctgtaatcccagctacttgggaggctgaggcaggagaatcacttgaacccggaggcggaggttgtggtgagccgctatcatgccattgctctccagcctgggcaacaagagagaaactcagtctcaaaataaataaataaataaaattaaataaaattagagatgggggtcctgctatgttgaccaggctggtctcaaactcttggcctcaagctattctctcatctcggcctcccaaagtactgagattgcaggtgtgagccaccacgtccagtcacatcagccacatttaatgtgctcagtagtcacatgcagcaatgactatttctttcaaccctwttttttttttttgagacagagtctctttgttgcccaggctggagtgcagtggcacgatctcggctcactgcaacctmtgcctcctaggttcatgcgattctcatgcctcagcctcctaagtagctggagctacaggtgggtgccaccatatctggctaattttttttggattattagtagagttggggtttcaccatgttggcaaggctggtctcaaactcctgacctctcaagtgatctgctcccmycagcctcccaaagtgctgagatwmcaggctctcccacccaggctggagtatagtggcacattcatagctcactgcagcctcgaatccccaggctcaagaaatcttcccatctcagcctcccaagtagttgggactacggttgtgcataccacacccagctaattttttttttttttttaagtagagacagaatctccctacattgcccaagctggtcttgaattcctgggctcaagtgatcctctggcctcagcctcccaaagttctgggattacaggcatgagccatggtgccctgcctgcagcaatgactattatattgggcaattactgggcagttctcaatatttttctgatctctttttcagctttttgcccttaagagatctttccagacaattcaacttggtgttcataaaaacagcaactccctttctttttcccctcctaattatccgtttgctatgtttactaagttttgcaattgcaatgccaggtatatccagagtaaacaggtttggaaacaaacccctgaatttcagcaggcagagaacacgatgggcatttcagagagtggcagatagccccaagctgtgggcttgtccctctacttacagaggaacggagggcttggaagcatcaggggagtgagttaagggagttgcacagagaagattctactctgcattgaaagctctaatttcagtgagtagcacgcaaaaagtaattgttgtcatctctgctagtctaaaagcacaccactccaccaaagccctgctcagacggctgcctaaccaatatccttcttcacgttcctcctcctgacagaagcctgactttgtcctggtgtctacctgttccccatgcagccccttggttcaggggatgctgacgtggtcctcagcttcagggtcatcccaattagtctacagttactacattcagcaatctcctggtgattgtcagtggtcccggaagggacacatgggccaagatggccaattgtactgaagacaaggagtacatcccacacttgaaggagtgatttctctctcaatgccaggggacctgtgatagggacaggaggcagagaaactctgggcagaagagggcggtccccagcaagggtcctaccctcaaacctggaaccatggcccgaagtgagaacacggattcctgttttctgacttgaatgttgcctttccaaaaccacacatgacacgccccaccccccatcctgtgccataaaaaccccaggcttctccagcagagaagaggagaagtagctggacgttggagagaagcagcttgacttcagagggacggcttgacagtgttgcttcgaagaggatgaagagaatgttccccagcggggaaagattatcttcccgctctatcccttttccatctcccctttcatcggcaataaaatcctccatattcaccaccgtccaattcgttcatgcgacctgatttttcctggatgcaaaataagagctcaggtgccacaggtgtggacactaaaggctgtcacactgaccgtctgctctcgctggtggagagaaacaacctcatgcaaaaaggcagagggcccactgagctgtttaacacttaagccatccgcggacagcaaagctaaaagagcactgtgacgcccgtcctctggggtttccgggtttgcaggtacccccctcccttagacgctgctgtggggccagcacagagtttgctcctgccagcgcccaaaggcactcgccgcagctcctgaacccgctcatctacatgctccctcccacaaggggttgagcacaacagtgagtggagtttgccctgctggcaccgaagtggccgggtagctccagcttccgatactccaggtcccacctgtgaaggggtcgggtaaaatttcctgcttcacctggacaagaagacatgtgccagttgctggtggcagccacattgtgacatcccacaacaggcgagggagactggtggtgttgcagagccactgaatcaacccaccctgaagtccacctctgttatgggagataacatactccctcactgcgtaagccagattcattaggggtttcagtcacttgcagccaatagcaagctgactcacatacaatccctcctaaaaagacttctctgaccctctccgttctctggaccctgcgacctttctcaccgcaccaacccactgcatcctgcgtgccatttatgtccgtgtgtttctcccaccagccatgggcccactgaggatgagctctgtttcttcactcttctccttagcccagggttctgcgattagtaggtgctttgtaaattccatcgcacaaaaacatattttattgcggttgctttagaaagctggatagatgggtggaaagcactcttttgttttttgtttttcagaaactcaccactgtgatgtaaactgctctgttaggtgacactgcagtacttctatgccagtaaagacaggtttgaagatgctttatttcactgggacaaactacatgtccataaatgtcccatccgtctttctcccacttgatgatatttgcagactcagtaatttcctttctgcgatgaacatccctctttaacattcaaactcccttaaacagatgtagtgctttcccacaaacccatctggacaggtggcagccacgttaaatctcgtgcatgggactgcagcactctgggtactcatggaatcttcttccattcattcttgttgttgttgttgttgttgttgttgttgttgttgttgttgttgttgagacagagtctcactatgtcacccaggatggagtgcagtggtgcgatctcggctcactgcaacctctgcctccctggttcaagccattctcctccctcagccttcctcccgagtagcccggctaatttttgtatttttagtaaagacagagtttcactatgttggccagccttgtcttgaactccttacctcaagtgatccaccacctcagcctcccaaagtgctgggattacaggtgtgagccaccaggccgggcttcttccattaattcttttttttttttttttttttgagatgaacgttcactctgtcacccagactggagtgcagtggctccctcttggctcactgtgatacagttctgatgaggggaggagggttcttgtctcatgtcaaattaggtaagatgacacggacacacatggagcggttttaaggagcggagtgtttaataggcaagaaggaagggagaaggaagaagctcccttgtacagaggcagaggaatgggggctccaaagccgaaagaggaggtccccacctgccatggataccagccaggtatatatacagaggctggagggggcggtgtctgatttgcatagggctcaggggattggtttgaccaggcatgtcattcatggtagcccatgaaaaagctggccctcccaccctagtcttttaatatgcaaatacagggcgccacaatgttctacacacgtggggatatgtgggggcggccatgttgccaggaacaggtcgggaaagggcaagaaggctcgcgacccagtttctaatggctggcatttgcatatcaaaggttgcccgcctggctctaagagcccgggctttacagaaacttccggagatgctttaacaaacgaaaacttcccaaggaccccttttcctttctatctgcctaaaataatttcttaataactcctaccacaacggcaacctctgactcccaggttcaagcaaatctcatgcctcagcctcccaagtatctgggactatgggcgcgtgccaccacacccagctaatttttgtatttttttagtagagacagggtttcaccatgttggccaggctggtctcgaactcttgacctcaagtgatccacccacctcggcctcccaaagtgctgggattacaggtgtgagccactgcacctggccccattcattctttccccgcaggggctgcccatcctttctagatatgcacccccaccattagaatagaatccaggtggcgtctttaaaagagaaaccaatactgccctgggcaactttacgttagggaagaatgttttggatttaaatcaaaggttagtgtttagggtcccttctgcaggtgggcaggggccccagagactaagggtggagacactgcttggccccagggtcacctttgggcatcagggtcacacagtgcacactcctgcaggtttgtgcaggtttctgatgccccttatcttccctccaagccggtcactcccatttaaaaaaaaaaaaaaaaaggcacctacaaccttctggcgattaggccaaatcttagagtcagcataacccttctctttctcttattcctccatatcccaaccatctaccaaacctgctggctttagcttgtgatgatggctaccatgctatcgcctggccacaccgctccgaatacggaggcctgggcgtccatcatcccttcttgactgtggcaatcacctccttgctggtctccctacatcgactccctgcattgatcctgcacaatccatgctcacaggcagccagagggatccttttaaaatattaaggcaaaatacataaagtcctctgtgccaaaccccaccccatctatctcagaatatgacccagatgtctttgccatgacccatgaggccctccataacctcagctcgagctcttctccttgttccctccatgctgaccctcctagaacacccccagcacactccaccacagggcctttgcacatgcgggtccatctgcctggaaacttcctcccctggatgtgcacatggaagactcatttaattccttcaggcctctgatcaaagggggcgcatctcagagaggacttccacatcccccagtctaaagtaaaccctccagccacttgatatttcaagtatatgtgcacacatacacacatatgtctatgtgactgtacttgcgggggcaggctgtacttgtttttcactgcccctcccaccccgccagctccccgagaacagggccttggtctttttcatccacagttgcatcgctggtgcctagagcatgcctggcacgtagaaggtgctctgaaaagagctggagtgtgattaaaccgtggaatcttctgagagtgctgcctccgcagagaactcggggagacagaagctgcctggcccagggcatctgattccagggcctggacttcttgtctggtgtccctccaggaaggtgtccctaagagaataagttgtactttctcttctcagtacaaaggatctttttgtaattctctggcatgggaaccattccagaagccccagagtcaccaagcttggccacactgaacacacttcctagaacgagcctcaaatggttgggtctgcccgtctccagacacccagttcctggacagtcaccgcaggcagctcccctgtccatcaggacagagctggacaatcaaggtgtggggcttggtgcatctgagggttcatctcgggccacccccgctccagtgaggaacctgcaggccaaggaggggacgtgactggccactgagggcattgcaggcaaagccggccaggaccggctttctcccaggccagggcgctttcctgatggaagtttccggaagccttcatccaattccattcgttcactcttcttgcaagtcagcagggcagaggcaggggcagcagagccccacttggcaaatgaagaaactgaggcacagccaaggtcagtgactcacctttcttcaaagagctcattactgcggggcccccagtgagtgattacagagtgggtcccgagccatggcctgggctgggtcctggttctaccactttcaagctgagcgaattgctcacccctgtgtgcctcgttttctcacctgcagaacaggtaataagcataattgacccgtggcttttacgagcacagtgaaacccaggcatcagcaatgggaggagcccagccctggaggcagatgccagttccaccccacccggccctccgcccaccagctcccaggctcccctacccctctgcagatggaggtagcggcagtgcctcccacacagggcagttgcgagaattcacgatggtgttttgttgattcgatgtgttttcgacgcttcttgtttcgttttgtaaatcaactagagcagtgcctccacacggcaagctcgatgtaagtatttgttaaataaaaatatagagaatgcatgtaaggtgcttagaccagtgtctgatgtgagtgatgcttggtgagtttcagctgctctgacttttagtgacaaggaccagagcgtgagtcgtcctgacccccctacttcccttccgtccatggtaacccccaggccacatctcaggctctcagggtcgcccagacaccgtttctccttggaggtcgccttgctctctctgctcccatatcccactgtctgcctcctccagacactctgtctcccacacatgcgcacactctcacgcccaacatacacactctcacacacacatacatacattcttacacacaggctcacacactcatacagtctcacacatacacacacagactcatacacacacacacatacacacaggctcatgctcacatatacaggctcacacacatacacaggttcacatacacctacacttacacacattcacgcacacatacacgcacacaggccccaacacacctacactcacacatacattcacacacacatgcatacatacacacaggctcatacactcacatacacacatacacacattcacacatgtacagactcacatacaccctcactctcacgcacacagtcacatacacattcataggcgcacatatacacacactgtcaccctctcacacgcacacgtgtcccctgagacacgtgctacccaccgcgtcctccctgaagctcccccccctccctgctgcccagatgcccagcttgggggctgcctgcactgccaggactcagctgacgccctggcccggggaagctactgggactcgcccctctgctgagacaaaacgggctgcacaggctcctcatggtctccctgccccacccactcctggctttgtgcccttcccagcagccataaccaaccccagccgtctgctcaggcctctggtgcctccccaaacccaacccagagacgctggcagtgctgtcaccctgtcaccaggcactcaaggcagtgtacaactgcccccaggcaggctggactctggtctcagtcagaacccggagaaaaggccacagactccacggggcaatggaaagaaacggatggaccagtgctaaaaggctaaaaggcgaccagctcccacagtgcggcctgagccgtggaaggacaagggccacagtcacacccataatcctccttctctctgctggaacacctggttggccggagtcacccgaggggcttcgggagtgccgtggaggaggaagctgcggtccactctgctcttgcactggctcagcacagaccatgggctcttctgagacagcaccaggccaggctcagagagggccaggactctgttcccacaaagcaccggggctggtgggggacccacctgtcaacagtcaatagcagagcaccagcatgaaataatcctggagtgggggtggccccagcaggaagccctcagctcccactgggagtgtgttgcagggggtggtcggggactcaggtggggtggggggggtggtgttggagtgcaggccttccgagcatgagcaggacatgaaaagaaaggaggcaacaggggtggggtgggaacacagccagagccaagaacgtacttagtgggagcgagaaggcggctttggtggatagagtggacagggagaagtgagaaccaggttagagaggggctggaacccagagggcagaggcctgagatgcccatggcagagcgtgcactatgtccccttgatttaggcattgcctgccacctgtctcatggagggcagcctgggatggcattgaacactttaaagatcaatttattttttaactatataaatttatttcaacagcaaactttatatgcttaagtttattggaaaacattaagtagaaaccaaagcaacatcatcaattgcaggtaggtacatacgacggcctaccaaagacactaggcccaaggctggctctttcttggttccagatggagatgaacagtgttggaaaggtgttaagattattagcaccaaactgggactcttctccttgagacaatggactggctttctaaccatgtgtctccatgttatggcaagaagatctgagtcacccagtgtcacctgtcatcatccccaggggagcagatgctgttcgtgccctccacatagccctggaaccctccagcaggctcagagccacttctaactgccaatatcttcttctttttgcctgcaggcttttgtccatgacctcagcagtccactctacccacacctgtggcaggtgggaggtgccaggggattaacactcacctccaacaacccccaagtaataactcataggagttggtgtataaataccgcctgtccctcgctcctgggattcctctattgtgtgtgatttctccatgggactgaactccagctgtcctctgcaccagctggctgaatactacgccctgaattggcctcctccctttcctgttgcgcttcctaaagccctgccagagcttcctgaggtcacctctcaaataaactacttgctctcaaattcttgtctcggaatctgcacctgggacaacccaaactaaggcatcaaccatcagtgacatctgtcccacccaccctcaaggtcagaccccaaacctgagagactcagtccaaagagacccagaagacagcttggcccttataactagatgagaaatcaacccagaagaagcctgcatggcaatttataatgggaggggttggatttttctgtgaaatattttcatatggcattgattgctgacagtgaaactagaatgaaatcaatcagatctgcagttggaaaagctcactctggctcctgtcgtgaaacgtggatgtgggcggtgccctggtctgcacagggagctgggtcgggtaccactgcagttgtcagaggtgactggaggggtggccgcccttggcaggtatttaggaaggacaatcacaaggaatttgaaatggattaagccagggaaggagattgaggaggaggtgatttctgacttataatggatagaagtggcagtcactccaaaggcaaacacagcaggaggagcaggtttgggaaggaaggtcaggagttcagacccaggcacactggcttgagttgccttcaaaacatccaggtggagatgtcaagatgtctgttggataaatgagaccggaactcagaggagaggcaagaacaacagtgaccatcgccctgcagacataaatgagggaaagggtgtggattttaagagtcgtgtatgtatgtttcttttttctttttttatttttatttacttgtttatcttttgagacagggtctcactctgtcgcccaggctggagcacagtggcacaatcatggctcactgcagccttgacctcctgggctcaagcgatcctcccagctcagcctcccaagtggctggaactacaggcacgtgcacccatacccagttaacctatggttttgttttgcttttggcagagacagggttttgccatgttgcccatgctcaaactcctgagctcaagtgatccaccggccttggcctcctcccaaagtgctgggattacaggtgtgagccaccaggcccagccatgtttcttaaaaaaaaaaaaaagtttaattttaaagaagtttattatttcatttctatggacatggaaaaaaatgttgagttatgatacaatatacaaacataaaatttaccatcttaaacattcatttatagacacttgagttgctttcaccttttggctattgtgaataacgctgctatgagcatgggagacaaatctctcttcaagtccctgtttttcagttcttcggggtacatacctagaagcgggatggctggatcatatggtgattctatgttcaattttttgaggaactgccatattgttttccacagtggctgcacccaaaggttttacgttcccaccaacagtgtacaagagttctaatttccccatagcctcaccaacacttgtgattttctggtttttgacagtagccatcgtaaagggtgtaagttggtctggccaaggtttttgaactacagatgtcacaaagatacagagcaagaaaaggacttatgcaacatcataataagccagggagatgttctggtcatacctacatcattatcaacctcatgaacttggatcagttgggggtgctcttggctacaagtagcaatgttatgaaagcatttgctgtcttgttaataagaactccctgggctggtcttttctgctcagtcaggctcagccgattggtgacagtgacattgcccttcctggccatacgttgactcttcaatgccatgcatatgtgcgctcaggaccacacatagagcagcaggaagggggcatgaggcaggccccctccttccaagattctggcctttttaacaggaagaaagtgacttccccaaaacccagcaaatacttcctgacatctcattggcaagaagcagtcaagtgcccacgcatatgactggcgcagggtaagcggtgctagttaaagcagggatggctgggccccacccacagagtttccgattcagtgggactgggatggggcccaagatttggcatttctaacaagttccccggtgatgcagatgctgccagtccagggacaacacttcgaggaccactggcttcagtgatcttgagctgggtacgtgaccacccaaaccaatcaaagggaaaaaggaggtaggtggtggaaaatacaagactttctgtcacaaactctgtggagctcacttgtatcttttttgctcactagactctaggccccctgggagcaaggggtcacgaaagtcacctttttgggccttggggtcttgatacagttactgtgacttggtggcaactttaaacagatttttcaaatgagtggataaatgaacatgtcaccaaagatgtccaaggctgctgcaccctcaagtcaccttgatcaaaacaccctcctggaacccatgcaggcagcctccaaaacacaaagcaggctgggcacagtggctcatacctgtaatcccagcactttgggaggccgaggtgggcaaatcacgaggtcaggagtttgagaccagcctggccaacggggtgaaaccccatctctactaaaaatacaaaaaattagctgggcgtggtggcaggcgcctgtaatcccagctactcaggaggctgaggcaggagaatcacttgaacccaggaggcggaggttgcagtcagccgagatcgcaccactgcactccagcccgggcgacaaagcaagactcaaaaaaaaaaaaaaaaaaaaaaaaaaacaacaacaacaaaaaaaaaaaaaacacaaaacacaaagcagccccttctctaccaggacagcagctcccctacaaagcagctcaggtgtcttccctgtcagcctgtcctcccggggaggctggctccctgctctgcagtgacactgcagggtcagaactcagcctgtggataacccaagaacaatgcctgtttgggggtcttcaccgctgacacagagagcctgtggccatccatcccaaatagtgtctgttagttgcccactgggatgtggtcccttgttgaagtcaaagaaacaagcccttaattcactaatcgcctaaacagacaccaccggctgagaactccaatagccaggcgtgtgatgccttatgaccctgagtgaatgcagctgcaaacagccagtacctgttacatattccttagccacaggggaaacttctggaaggttgctagcatggaatatgattaatgaagaagaaaatgccttatccttctgttctacattcacactcacatgtgatccacgcagtggtcctgaaaggatccaaggctgggggagatctgggagtccgtttaccgacaaggatctgctactcagagctgacgtcccatatatgtgcagtgaatattcaatcagcagtagctgtgatactcataaatcactcgctctgaggtgaaggggaaccgactaggataagccaggctcaccccagaggcctctgctgcaagcctggttggcagcccagcccttgtgggtaccaggacctgccagagccacagacgaccggatataagcacaaattgatgagtcacccaagagccatcgcagggtgaggacagacctgggtgccaagtgggcagcgattccatcaagtcctggcagaggaccaggctgtgacggacagaagacactgctcaggtcagactcacgtggcaaggcaaggtcttgctggaaggcaggcaaggaaatgctccagcaggagcccagcagagaccggccctgggtgctgatcaggaccaagctggccccagcctctgtccagggttgtacagggctcagggagctgcgccaaggtggaacaagagtagaggccgggggcggtggctcacgcctgtaaccccagtactttgggaggccgaggtgggcagatcacttgaggtcaggagtttgagaccagcctggccaacatggcgaaaccccatctctactaaaaatacaaaaattagctgggcgtggtggcgtgtgcctgtaatcccagctacttgggaggctgaggcagaattgcttgaaccaggaagtcggaggttgcagggagccgagatcacacccctgcactccaccctgggcgacagagcaagactccatctcaaaaataaataaataaataaaagagtcaaagccctgggtcctcttctcccctgtgttagccttactatgtgttcttgggggtggtgcttcactcctctggaacagtgagcctcacatacctgactctgggccatgcaggggccaggctgggcctcctcacacccactgactccctgctagcaaccccagttcccatctcccatccccccaccctaacttccagggcagataggatgtatgcactggggagtggacacagtgctctctccagccaggtggaaatgggaccagcacctccctcgtcaccccctccccagacactgtccacagcccagatgggctttcatgcacctcggcagccggcctcccaccctctccccaccaccgcaaccaaaactgcttctgtggatgcctactggcatgttttgaagttacctacacatttatttcagggtcaactagtcctgagcacctctggggaaaccttataccactctccttttcccccaggactccccagggagcgggagttctcagccctggcgcaggctggagccacctaggcagctttgaaaaccacccatgcccgtaagggatggaactgggatgctgaaaatgttccaaaaccagatgacagtaatggttgcacaacttgggacatttaaaaatcattcaatggtacacttaagatgggtgaattttatggtatgcaaattatacctcaataaacttgtttttaaaaaaaaaaatacccaggcctggatctatcactgaaccattaaatcagaatctctgatttggggcctgggctgagattcctgctctggtgtcaccgtggggacatctctttccactgtcaccatcactcattcaccctgggagaagaggagtgaccccccgccccccccgccgccccaactcattgatgggcatatccatttcctagagcagttataacaataaccatgaactgggtgactcagaacagcagtaattgactctctcatagttccggaggccagaagtccaaaatcaaggtgccagcagggccacactcctccaaaggctccagggagggtctttccagctgctggtggctgccagaagcatcactctgatctctgtctcctccttcacatgaacttcttccctgtatctctacgtccccactctctctgtctcttttttttttttttttttttttgtgagagagtcccgttctgtcacccaagctggagtgcaatggcgcaatcttggctcactgcaatctctgcctcctggattcaagtgattctcctgcctcagcctccctagtagctgggattacaggtgcacaccaccaagcccagctactttttatatttttaatagaggtgggatttcaccatgttggccaggctggtctcaaactcctgacctcaagtgatccacccatcttggtctcccaagtgttgggtttacaggcatgagcgaccatgcctggcccccactttctcttcttagaaggataccaatcattggattagggtccaccctaatctaagtattacaccctcatcttaactatctgcagctgcaaggtccccaattccacataaggtcacattctgagtttctggattggcatgaattggggcggggggacaccgttccacccagtacagtagaaatgctagctgagtcaactgcattaaagccggtcatcccattacctatattacatacacactttcctgggtagactaccttatttatttccagttaaatgcaatttttatcgtcaaaatttccaagacttctgttagtttcctaactggagtgtagtggtgcgatctcagctcactgcaacctctgactcccgggttcaagcaattctcgtgcctcagcttcccgagtacctgggaccacaggcatgtgccaccacacccagctaattttgtatttttagtagagatggggtttcatcatgttggccatgttggccaagctggtcttgaactcctgaccccagacaatctgcccacctcggcctcccaaagtgctgggattataggcgtgagccaccacgcccagtcctaactcattatttttttattgcagctttaggtgaaaagcatctttacctacatgcccctgcatatggacatccagtaccaaatattctctttttaaaaatgtacaggctgctgggtatggtggctcatgcctataatcccagtactttgggaggccaaggcagaaggactgcttgagcccaggagttcgagaccagcctgggcaacgtagtgagacctcatctctacaaaaaaatcaaaaaaatagccaggcgtggtggcatgcacctgtggtcccagaaactcaggaggctgacgtgagaggatcatctgagcccagaaggtcgaggctgcagtgagccatgattgcaccactacactccagcccgggcaacagagcaagaccttgccaaaaagaaaaaaaaagtacaggccagtaataaggtaaaattcacaacagagtctacctaccagagtggagtgggagggaatccgcagagtcagacctttgccagcggattcactctcatttagcagagggaagtctctgtttgtcctcttctctccaggttccctgcctcggctcctgtgtgagcttccaagggctggtctcaggggtgagaatcaaaatgtctaaccacaggccctgactcatcagcccagatgcctgctgtaaacaaccagagctttttccaggcaaatgttgacctagctggtctcacacagggcagcatcagcacttccaagaagttctcccaggggcattgtgcttggagacagtttctgtgtgagcctgtgaacagccagtggtgcttaaaatcatgggcctctggccagcctattcaacattaatcgtaagtgcttatgaaaggttggcgttagatgccagattctgttctacgctcttggtatataagctcattaataactcgcaacagtcctagaaggtggagagatgattgtcattgtccctatttggcaggtgagtttaaggaacacaggcccacagtaacacacagttggtgcgtggtagcactgggattgaagctgtgtggatttatctctaaaaactagggtccagtccctccattttaccacctcttctgtttgaaaacatcacatatgggatattcattccttcatttaacaaatatctgtcgagtgtctactccatgcaagacagtgttctgggcactgcagctacaacagtgaacaaatggccacggcccctgctctcctgcaggtagtgtgggtggggagtggggagggggacatagaccgcagtcacagacagaaaataaaaccagaatttcagatagtggtatgtcataggaagacgctaaaatggggagggaggatagagtgattgggaagcatttttaggtgaaacagacagggacaaactctcccaaggggtgacattatgctgaaacccaagtaatgagaaagagtttttggagcacaatctggggagagagatgccagggagaggccacagaaagtgcaaaggccctgaggcaggaaaaggcttgaggaacaaagtgaaagatacctttgtgtctctgtgagcaagggagtgattacggaattactgtcctttcctttggtgtgataataatagggaggtcacctgggaaaacaactgattcttaggagatgcctgcccaagtcctgaggggtaatgtgtcatcatgtctgcaaccacctctcaaatgtttctgcaacttataaagcacacatggcaaaatattagcaactgttgattctaggtggagagtataagtgtgtccactgtactattctttcaacttttccatgtgaaattgtcataataaaaatggaagcaagacagcagcgaaagatgttggagtgccaggcaggagcaggatcgcgtctccatctaagaggaggagattttaggctgaagagtggcgtgatctggtttcctttggcatcattgcctcaactgccctggatttcaaagtctggctttgcagaccatgaaggagtatctctctcaggagcacaagacagcatgtttccaattctgatttagtgaacactcattgtgtaccttccagccaggcgttgtgtgtgcgttttacctttatcaatctcacttaatccacatgacagccagcaatgtcctcgatattatcctcattcttaagatgaaactgaggcccgggaagatcagccaaggaggggccagacagtggaggcagagcctaggttcgttagaaacctcagccctgggggggccctaagtcatcattccacttttactaaatcaccatcaacattcatcataattgattaattaattatgatcaaagcttaaaggtgatttttctgaaatacgattgcaaaactagatgcactgttccagagagagccctaaagtgaattgcactaatggtcaaatggatcctgcttttccccctgagaaaactatcatccaacagagttccaagcactctcccttgtccacagagatctgcagctgtgctgcctggggccacattactcattttaatattcaattgcacatttgctgatgctgtctgtgtgcctggatttcatcacatcacaaaatatgtggaacccacatctttaatctttcttgcctgcttatccaaaggaaaaccactagtgtggtaagcaactagacaaattgtcctgttatctgcgttcttagaacagtatcttaactggaggcagccctactgtctttcactggtaagaattcagaataaacatcatcattctttgaaatcactcataagcagcccccaggagactgcaattatacccgtttataattctcctccctcccaaactaacccttgattcataaatgtgcacttttcggcgtcaggcgttagaataaattagactatacaattatgtataattaaaggggaaaatgggtaccgtgctgcaaagattagccgtgttttgctgaagtaaagcatgtctgtgtcagcgtgctggcccagggaggcagcatgaaatacaattaatgttcttcttacttaatgggggtttatggtactgtttttcattatcacagtatctcaagaaatataaacagtttttctctaacgcaattgcatttctactgacaacacagcttgggtctaaatgaaaattcagcagaattaaccacaggtttatattgttatggatgatcctggaatctgtattttaaaagccatgcaaaactgtgtgcactcaggagccgagaagtttgatctcaacctcctgagagtggttctgcagcctcttctgctcttgtagaagcaacttacagccaaacttgtgtgcattattaaagccacctgtgccccagtactacggctagcattcccaagcctcccgtctgcagccatgttccttcttctaacgtttctcctttacacgccaatttgtttgagacatgttaaaagcttgacttttacaaccctcataaaatcccatcgactccaacccaaatccagccagaagtgctcggacaatcagattgagtttcaaccacttgatggagataaagaaacacatagcaagaatgattttttttattgttatatatgagtcaagggaataaaacagcaactccggccttgcaagggagatagaaccggatggctgttctgcacaaaagggctgccaaagaatctgcagagggaagaaacgaggcatggaggcgtcaagagaaaggtccccctgaggttaaatcaacaatgctggggagaatggggcggcatgaggagcttgaaaagcttgattgtccagctaggatggtcaggatcataccaagagatgtcatgggggatgagggatgtgggaggagaaaagctgtctccgtgtgggtggaggcggcaggggctggagtatcaggaggccgtgggggtgcccaggattctgctgagccccaccgaggcccggctgagtgacttcccaggctgggggacatgtgagccctcggggcccctcatgtatcccaggcagacactgagctccaagctccgtaacggggcctgcggtccccaccggcctggaaggacctggaaaacaggctgaggccttgaacccagaggaccagggagtttgctgggaattatggggaagaaacacggccagaggagctttgcagaccctctgacctcatgggtgtctgagccagtaagtccagactaaaacgcatgacccatagcacctgcctacaatgaacacacacatacatgctcggacacacaggtacacatgcatgcacacacaagatctgtccccgtctacttaaggaaggataaggggccaacatagacgttaccatgtttggtaatgtccagcaacaatggaaacaacatatccaaaaagataagcaaatgccacgtgtccgccaggcccacagccccagaagaagggattgtaagcatcccctctctgactggggttacctgacgagcagagaaggatggagtgaaacattgtgggcaggatccttatgggtatgggagagccatgttcaggaactcgaggacctaagggcacagtgtggtaatgcagtggggttttttttagactttttttgccgtggaaatttccccacccctgaaatattctccagaacccaacataaaaagtaggagggaggcagatcccattcctgggcctccctccaccaccccaggccccagaagcaccaccaaggggccctgaggattcagtaagaaaattgcttctgcagtggggtacatgtccccaaaccagggacagcatcaaaagggttgaaatcccactggccaagtttttgactataggcaagaccctttatctctctgagcatcagtttgcttgaaagattgtcaggaggattacatgaaatgacccggtggaaacagccattgaccgcagaacctgccagagttgcactgtccagcatgggacccctgagccacatgtggctggtcccaattgagatgtgctgtaagtttagaatgtacaccagattacaaaacttagtaagaaaaaataatgtaaaaatatctcattaattttatattgattacatgttgaagagatcgattttggatatactaggttaagtaaactatattattaatattaaaattaatttcacctgcttttttcagacagggtctgactgtcacccaggctggagtacagtggaacaatcatggctcactgcagccttcacctcccaggctcaaagtgatcctcccacatgagcctcccgagtagctgggaccacaggcacatgccactatgcccagcctaatttttgtatttcttgtaaagatggagtttcaccatgttgcccatgctggtctggaactcctgaactcaagtgatccgcccacctcggccttccatactgctgggattacaggcgtgagccactgtgcccggccctcacctgtttctttttactttctaatgccactactagaaaattctaaatgatatatatgtccttctgcagagatgaggcggaaggagaggggtctccattatttttcggtctatgatggtgaagcctgacattctgtcccagggcaaagaaggtgggagctgttcagccttatcagtgatgccaaaggtagggccagcacctgacttggaaaagcaagtgcaaggtttttctgatttatttaggctctaacttgattggcgtggctaacagaggttatggggaggagcctagagctccaaacccagtcaggagatccgatttgaatttcagatttaaaaatgaatgattttttagtactaacttcctccccgtggatgtctatatttatttgttaagtctgacaactctaccatggaggatcatatcagagaaaggagatgctaggttgaaaagtaaaaacatcctaggatttaagagcatgagccgggagctaaggcttcttggcttcacaggatccaccacgaataactgtgtgatcttcggacagttactaaacctctcttggtttccatggtaaaacgggcatagtaacttactgtgtgagattgtcacaagatttaataagttactgctgtttacaagtgctttcccacagcggcgtctgtttccccttagctagcaactcggctgtgttttctgcagctgctggtgagttctctgcccgctctttgcccacccgcgtcaggccggtccccctccggcctcttctgtggcgcgagggacagcggaaaccacggtagacagcacccccttgagtccaattcctcccctttcggaggaagccggtttctcctttctatgctactcccgggccatttctggacaacagctgctattttcacttgagccgaagttaatttctcggggagttctcgggcgcgcacaggcagctcggtttgccctgcgattgagctgcgggtcgcggccggcgccggcctctccaatggcaaatgtgtgtggctggaggcgagcgcgaggctttcggcaaaggcagtcgagtgtttgcagaccggggcgagtcctgtgaaagcagataaaagaaaacatttattaacgtgtcattacgaggggagcgcccggccggggctgtcgcactccccgcggaacatttggctccctccagctccgagagaggagaagaagaaagcggaaaagaggcagattcacgtcgtttccagccaagtggacctgatcgatggccctcctgaatttatcacgatatttgatttattagcgatgccccctggtttgtgtgttacgcacacacacgtgcacacaaggctctggctcgcttccctccctcgtttccagctcctgggcgaatcccacatctgtttcaactctccgccgagggcgagcaggagcgagagtgtgtcgagtgagtgtgcgtctgtgtgtcccggcgagggtgcgcgctcggcgccgggagcgcggccagccgagtccggaggcatcgggaggtcgagagccgccgggaccccagctctgcgttcactgccccgtccggagctggacttcggggccggggccggggccgtgcgccggggacaggcagggccgggtcgcgggccgcgcgtcccccaggccggaggtaaaagcgctagcgcgcggagggctcgaggagggcaccgcggctgggccccccgcgccccgggccccagccgnccgcggctcccggcccgacgctccccgccccggagcgcgcccgcctcccctgcgtggaggccggcgggcaggcgagcggggggcggtagcgccgtgccaaggggctggctggggcagcgyggccggccgggctggggcgatttaagagcggtccgggcggggtgcggagccggactttggctggggcggcgcgcggggagggggccgggggcggtggcggcggcgytggggggcggggaggaggcaggaggaggagcagcagcgctcgccgggggatgcagcagcggcagcggcggcggcggcggcggcagcggcagcggcggcgcggagtcccctgcgcccagcggcccggccgggctgcggcagaggcggcggcggcgccccgctccgggtgaggttgccggggccgtgcgcgctggtgagtggggcgtggggggcasgtgggtggctgggggacgcggggctcgggcgggggctcgcggcggccggagccttccccggcgtgagcccggccgcgagcgccgcccaggtgagccggggctggtccggaccgcccggctccagccccagcgctgcttgcggaggtgggtccgggcgggcgggagggaggctccggcgccggccgtccgcagagggatgacctgtttgaccccgctggctggcgggcgggcgaggacttcccgccgcgcccctgacccgcggacacggcacaccgagcacaggcggccccgggtaggggagcgcgcctgggccggccatccgcaggggcatggccttgttgacccttagggtttagacccaagggaccggtagatgccagcccacgtggggcttgtccgggcaggactcggggaagcagtgggccggatcttcagagtggttggaaactcgcagacaccgaaaggacaaacaggatcgaaaaggcagacttcctcccaggccagggcagaacgagtttccatcgcctggcggagggatgctcccctccccggctcctcggggtttcagaagtcyagcggtgrattctaggagtgcacttttccaaacattccttatagtagttcgttcattcgttctacaagcatttctggagcaccccctcgtgccgggcaccgcgttctgttccagggaaacgcggctgaacaggatctggctcctgcgcgccagaagctgccggttcactgggagggcagcagggtagagagatgccgtctcggggtggaagatggaaagggaagcctgcaatcctagtttgcacactggcctcggtccgcaactcccccacctgcacgcagtaggcccagcacacagtaggaagagcaagccagacctgcctgtgacgaccctctcctcctcctcctcccccttgaaagctttgattcattccctgcccccctttctggaaagtcttcctgcagcttgttttaatcactttttgagttaaaagtcaatatttaattaaccaagtaattacattcagcttacgtttcaatctgggtatttgctcatctgtgcgtgttgggacacccgccctctcgcccctccatctgtcccctgcctgtttcccaccgggtccacccccacttttggggcagagaaggggaggctgcgctggagcaggttctcagggggagacagggagcaggagagacgggctttctctggaggacacccccggatctgcgcgctctccaaatttcagcttgtagtgaatagtgaaggtgatttcttgacagcctctgcctcccattacagaaccaccagagggttctaattaaattagagccaatcgttaagtataggaacggggtagggaggacagaacgaagggggccccttccctgtaagagatgttctccccagcttcgtctctcccacatcatagagaagagaaaactcatccagacagcctgtcggatgtgtaatttagcgttctaataagcagcttgaaaggcgaaggtggtgggcttggcagatggcatgttggacctttgtacatgaaggcctcttccttccccagctaaatttatatacataaaggccgtgatgttggcatcactgctgcagctgagggtcaatgtgggtttggggtttgggctttgtgtgtacttcttgggttttttatttgaatttatggctttttctgaaaccctaataacatgttaaattttcaaacttgagagtagagtgatgagttgactgtaaaagtctggtcttggaggaggacagcatagcagtgtgtgtgcatgcacgtgcatgtcccccagttcagctgctgtccaaagaacccagttgatatgcagtttcacacctgatttggacctgatttgggagataacatttccttctcactttttctggcactggttagtttatctgcttggacctgcctcaagagggcagctgggttaaccaggcagaatatcacccaactctgtcaagctttggccattatctgaccttagactttagtcctgcagaaggagtccagaagccctgtcctacagaaaaatatcagcatttctgaccagcttgtagttaaaagaaaaggtttagtccagacttaagataattggtaacacttaagtagttttgtatgggcctgatctgaggcattgatctaagcccttataccttactcattaaatccacacaaataccctgttaagtaagtactgccattgttgccatattaaagatgaggaaacaggcacagagaggattgtgacttgcctacagctggtcacaggtagagctgggattcaagaggccctcaagctccggggtccacttggaaccactggactctcctccatgaccttggcctttgtcccagatgtagaagaaacacatatgcaggggaagaaaacaccttcagacagtcaaactttgcaaagtaaaaggcccttaactttccataaacccccactgttccgacagagagtccgggtttgtatttgaggttttttgccccaaggaaaacatgtgtctgcctggtgctttttcttctgcttatgagcagacacactgtcccctcccccagtcaaaatgcaaagggaaacatcaaatgcagctgatggaaaagccaggtgaaccatggtgaagatttcagcccactcagagcacagtggccagagagcaaaagctctcctagaggtgagaccttcctgtggttggtgatggagtctcgatggcctggccctgggggtggtgccagggtgctctgtgtcaggcctgggcggatgtggaagatgggggcctctctcaatgctgatctgcaggtgagggggccctccctgaaacctgctttctctgggcctccttggaatgggccttggtggagatctacagacagccctggcccagccggattgaaggcactgtctaattgggagggcattaagatcgttataattaattggcatcccgataaatggcatggttgcctaattggggtggttgctagggaacgaggcctcacttggagcctaaaggggaagaagcgctgggctggccacagttgggtgtcagggtacagatccagcagtgaatggaccggaagggagagcagtccatccgtatctgctggtgtttactgagcagctgctgtgtgcaagttgcaaatggagtatcagttaggggtacttgcctagaagaactgtaaagtaatcaggttcctttctcttgcaagcaacggaaaaagagaagaaaaaaactcaagccagcttaaggagaaaagaagtggacttactggttttcataaccaaaagtcttaaggtgactaactctagcttcagacacagctggacccacagctcagattttgtaatgagaatccattcctatccaccgctcctctgccttccatgaggctgatgtctctccagctctggggcgggcagtccctggcagctgtgggcaccgtggctaggagagccagactgcctggctccctgcccagcagtgggatctggggcatgctacttaacctttctgtgccttgatgttcacatccaacaaatgatgatgatcatagcacctgtctcctgcttgtggtaagcatgaaatgagatgatcaatgtcaagtgcttagcagggcgtctgacccaggtgagccttcagtaggcattgactgttaccataacttaggtgtcaggacagatgtcatggagcagaggggtctcatcccctctggtttaagcccaaaaggaaagaacaagcctctgatctggcaatgcacacctgagccccatggttccctctgattggactgttttttgtccaaaccagtcactggctaaggaaatgagttgccaacaattggcttaagccaggctcacaggcctctccctggagctggatggaggctgactgctgagaccccaaagcctggaataaaacagcacggggagtccccagtgaaagggaagcccggttgctggagaggcagatggccagtgcctgcgatgatgggccactaatgtgagcaatgctggccagatggacccatcttcattttggccaaggtggagactggggaaacacgctgcctgggcaatgcctctcccttccaccagggccaggaggcatcaaaggcctgacttttctgccttactgtctgaaggatggggcctggccttgatcctgtgctttcggggggccaggggcagtgtttgtctaacctcccaccatgagaatcatctggctgtatttgtttaaaaaggcaaagaccagatcctgttgaatcaaacttctagggagggtcctggatgctggggggcatgaccaatatgtcatgtgtatattctatatcagcaggagggtttggcgaagagagctctggagcgtgggcctctttgtcttcctgcctaatgcaggggctgtcagaaggcggggaaaatgctctaggcctggcgtgctggctcatgcctataatcccagcactttgagaggccgaggtgggaggatcccttgaggtcaggagtttgagaccagcctggccaacatggcaaaaccctctctctactaaaaatacaaaaattagccaggtgtgatggtgcttgcctgtaattccagctacacaggaggctgaggcaccagaatcgcttgaacccaggagtcggaggttgcagtgagccgagatcgcactactgcactccagcctgggcaacaaagtgagactcagtctcaaaaaaaaatttaaaagaaaaatgactgcatgatgtgatggggtgggaggcaactttaggcaggctgtcagggaggcctctgtgaggatgtgacctttgaactgtgacctagattttaggaaggagtccgccttggaaagatctgggggaagagcatgccaggtagaaggaacagctagtgcaaaggcccagaggcggtgggaggggcctgtccaagacacctgccccaaacacaaatagaagtcaagtggggtaggccaggcgtggtggctcacgcctgaaatctcagcactttgggaggctgaggcagttagatcactggaggtcaggagttcaagaccagcctgaccaacacggtgaaacctcatctctgctaaaaatacaaacattagccaggtgtggtggcacgtgcctgtagtcccagctatttgggaggctgagacaggagaatcacttgaacccgggaggcaggggttgctgtgagccgggatcacacttctgcattccagcctgggcaacagagtcagactctgtctcaaaaaaaaaaaaaaaaaaagtcaactagggtagagggtcaggagtaagtgggggagggcacgtcagagatgagaaatacaggccatgctaagaaattttagactttattttaaataaaatggataactgtctggacgcggtggcttatgcctgtaatcgcaacactttgggaggccaaggcgggtggatcacctgaggtcaggagttcaagactagcctggccaacatggtgaaaccccatctctactaaaaatacaaaaattagccaggcacggtggcgcacacctgtaatcccagttactcgggaggctgcagcaggagaatcgtttgaacccaggaggtggaggttgcagtgagctgagattgtgccattgcactctagcctgagtgacagagcaagactccatctcaaaaataaattaaaaaataaaatggagaaccattggagggttttaagtcagagaatgatatgatttgtgtttcaagaagatcctgctggctcctgtgagaggcgtgctgtgcagatggaagtggtatcaccgggactgttaggcaacagagagggcccgagagtggcttggaccgtggtggtatcaatggagatggagtgaaatggggattggagatgtattttggaggtagggcccacaggacttcctagtggattggattacagagtgagggaaagggctttgattctcaaccgagggtgattttgacacccagaaaacattttaacactatccggagacagtataggttgtcccaactggggaagggttgctactggcatctagagggtagaggccagggatgctgcttaacctgcaatgtacgggatgaccccacagtgaaaaatgattcagcccaaatattcatgatgtatcctgccaaggagtcaaaggtgactaggcagcctggtgcgtggtgattgctaaatagggaagataggagagaaggttttggggaggaggagtgatctggaattccgacgtggaaatgttgggtttgagatgaaccccacctggatgtctgaaagctcagtgggtggtgaacgtggatgtctgcagccggtcggggctggcaacctaagtttgggagttatcggcatattgatgttattttaagctgtgggactggacacaattatccagagagaatgtgttttgttttctagtgtggttttctccccccagcctccccctagtgcctgtcatgaatctatttgatgaatatttttagcatatcccacatgctcacctctctgacatttccaagaagttcctgaaggctcgggctgagcctccccttcttcatcgcctggtttctcagtgattaacagacagagctaaatattcattgctctgccacagatgcccttgggaaattgcttaaggtcatgtgggatctcgggccttgtaggcagcacgatgccttctgggtggaacagctgttggcatggccttcagagcttctcctccagcccaggccagggcttcttggaattctctgtaaccagaatgttttgaattccccacgttctcttaatgtgattccaaagcacacgttgcccagtggccctggcctctgccatggagcgtcatcttacagaaggcctggcccactgctctgcacacctgggcccagcttgaatcttagataaattctatcccaaactcagagttgttatggccaggtcttgtgtgtgtaagttggtggacagggccatccccagggaccacaaatagtaccaaagatgtgtttggccatgtggaagccagatgtgttaggggaagaatgtggccaatagcttttcttattggctcatggtcaggaccccagcgggtgacttgacccaccccagtagccagagaagaggagcttttttgtttttgagacagggtcttgcactgtcatccaggctggagtgcagtggcacagtctcagttcactaccacctcaacctcccaagctcaagtgattctcccacctcagcctcccaagtaggtgggactataggcacaggccaccatacccagctaattttttttttttttttttggtagagatgagatcttgctatgttgcccaagctggtctcaaactcctgggctcaagtgaccctccaaaagtgctgggattacaggcgtgagccaccctgcctggcctggaactttttgaaaagagattgaaaaaactgttagctcacagaagccttggagatgttcctgcttggtgaaaatcagaccatctgaaagccacatttctggtctgctctcgagacagatactatccatagacttctgattgcaggccacttatctggatatttcagagaccaggaaagcctactataattcttagtagcttagagtcctgatcattttaatgtgaattgaaatggtttcattatgaggaatcacatttctgactgacagtggcttatgcaatagaaacatttaattctcacataacaccaagtccaaagcaggggagtccaggcgctggtttttcagtacaacagtgtcatccaaggtcccaggatctttcaagcctcttcttctgtcctcatcatgtctttggccttgttgcctcatagtctcaatatggctgccacagctccagacgtcgcatcaccctacaaagtgggactataggacaggactccttgctgtctctcttttaatcagagagtaaaatccttgccagaacactcccaccctagcagactttgctttctgtttcattggtccggagttgggttttgcactcacctctaaatcaaacactgggaaaggacctggctccttcctatgcttcggatctcagctgaaatgtcacctccctagaatgctggaaggacaacctgttttatgttttataacacttatcactctctggaattagcctggtttgcttatttgtcctttgtcttctctctcctcactaaaaagcaagctctgtgcttgtagggacattgtctgtcttgttcatcgctgtatccccagcactgagaaccagggtggcactctttggatactcagtaaatttttttttgaatgaaggaagcaagaaaagaaagaggcttggagagctacaggcacatctggctagcatgtttgctcgaaggtgactgctcagggcaaggatgtcaaaacctgttagtcatttgcaaaaagctaagcaggtggctgggaggattggtttcatacacactcacttgctccccagtgccagagctggggttttgtgctagcattgcttgcagaggaaggatcgtcccctttatgccacggcagggacctcacggccttgcagaagggctggtggaaccctccacttctgatgactctggggccaagctagtcttccaggtcagtggtgtgacattctaatgagggctcttgggttaaatatttctgcatgtgcccttgaaaagacaactcccttccctaaattgtcccttcctgaaagaacagcggtcacagcccaggagagcagcctctttaacctccactccccaacctaccctcctgaaagctcacatttaccgagcactttgtacaggctagtggtggtttaagtgcgcgctcctgtgaatgtggaataactcagcgatgtggggatcttccaaccccgttttacaaaggaggaaagagacacaacgaagtctctccttgctctgccatgctggtagaataggacatcacaggccacctaaccaggggctctgttcagctcgcagaaatgttttgtttgaaccttctaaaaagctgtcagatttgtaacaactacgagatttcacattttaaaaatctggattttcagcttctcctgaaaaatggggagatgtggtccccaccatcccctatagcctgacattgtgaaccaattcatttggcttttcattgcactttcccttctgtttttctcattgtggagcaatatttctctgttccatctctaccaaaagtggccagatgagagctggagaggaagtggggtgtggagttttcttatgcgtccacttcacccgtttacattatctgcctggcccacgtaggcatttgagtttgtctcccgttgtgacactttgtacccaatggctacacttccagggacattgcaagtgtccctggacacttacattgtgcattgcaagtgtgtagtaataataatgtctaatatctattgattactttttgcccagcatttcatcatcacagcaagcctttgaagcagggactaatatcatcttcactttatcagtaaggaaactgaggcactgtgtgtgatgccctcactagaacaggaggtcctgaagcttgttcatctttgtaccatctgtgctaggcttactggctgtttgaatgaatgactaaaggaatgaatgaatgatgttctcctccaagtgttcattagccgaagaggctgaaagtcttaacctcatagtcatttgtgacatttctgttgggggaatgggctctgatcagtgtcactgaggattcttgggttgtgtttctgctgtataacaaaccactccaaactcagtggtttaaggtaacaacattttattttggacgattctgtggtttgaccaggtggttcttcagcttcatgtgatatcagctggcaggtctaaaacaaccccattcaaatggctggcagctcttgctggtcaccagatgggagctcagttattctccatgtgggctctgccctatggctacttgggcttcctcgcagtatggcaggttcagggtagcctgacttctaagagtgcaaaaatgaaagctgccacggtctcttaaggcttaaccgcaaaaccggcacagcatcacttctgccaccttctcttggtcaaaacaggtcccaaagccagcccggtttcatgaggtggggcccacacaagggtttgaataccaggcagtgtggctttttggagtccaccaaagtacccattcatcacagactgcaagtagcagagcccaacacttactacctcaagctggaacaggatttactggggggctcaggaaaggacaggtcaggaactgaggaaattctggggaccttggcgcaggagttactagcagcctcctgaaggagagtttccatcccaatgcgacaaatgcacccctgctttttctttctgcccttgacactttatttgacagttggggacatggtaagaaagtctgattgaccttggtcacatgatcaccccttggcagagaggatgggggcatcttggcagaggggagggagtcctcaaaaggaagctggggtgctgtcaaaagaaggggaccagatggacaaaaattgttagaaatctctgcaccgcccctgcataggtgactccacccctggcagagcaatgaacattttaaaacgagtgaatggactttgaaagtccagtataagtagaatgcccaaacctgtgtggcagcttctccagctccagggccccatagctcaggtgctgctgggggtctggaagcttctctccactttacggggcaaagtcaactcctagaacccctgccatgcctcaatatccccctccagaagataggggcagtttgcttctggctcctgaaaggagagcatgcgcggtaatgagggacctgggctcaatgcctgcactccctcctcccagaccccgcctcaccagtgacactgccttccaccccaacacctggtgacacccagtgagtccccgcagcaggggaggctgctagtaggaaaaactgatccagactaatctcagctcgcagagcctctgacccgggctttcctcccacttgccggtctatttccggctgctaattagattgcacagcaagccacattgggaagccgacctgtcgttccaaaggcactccactcgcatctccaaatgtagcaggtgatttggtaaaagttgattctgactccttcccccagcttctaaaataattgtaagtgtcgggctgtttccaaggtgaactaatgaacagctcatctgctaatagcaggggcaagctggctgaggacggcacgctcgcctgtggattgggtgaaaaggaaagaagtaattggattattaataccaagccgtcaaaataccttttattccttttatattcttctggaaggaaacgacaatctctggaaacataaatacatgttctgtgggggtaagcagggctaagaaaatgtggggctgaaaaggaggagggggttaaaaaggtggaattgtcagtccccactgtggcagtctacactgagaaccagcccacagttaggcgtgaataatgactctgttcaagtcggactttattgcttttggccaaaggccttttgcagaaataactttgtaactccctgccagggaagcttttgtccacagctgagacaaaggaacaaagaacagaggtgggaatttctgtatctgatttctacttcctctaaacagccagaaaggacagcgggtgtggcctgcccagaaggcatgggctggggcaaaggggtgtccagcctcctgtgggccacactgccgtgctcggctgcaccatgttggtttcattgtgcacattcccaccccagggcctttgcacttacttcctccgttcatagaaagcattttgcccacaactggcttctcgcccgcctctgctctcagctcagatgccatttccttatgccacctcctcatgccagagaggcctttcccaatttactgtccatcctatcacctgacagcttcctccaaagctcttaagacaatcttcattcattcattttctcctccaccaaggtatcacagctccatgaggacagaggcctggcctgccttgtggccactgctgtttcttagcatgtggcacatagtaggtgctcaggaaagattggatagcttggaagagtcgcacatagctcccaggccaagctccagcggggctttatggagcccgctcagtgcttaaaataggttgaaagtttttactttggaaatggtgtttccggtgtagtccaggcgccaccccatctctatcctaaatctaggccactttactcactcaggtctcctgcccgacccttggatgcatttgcatatttgyccctgctttagacaaaggccactgcaaacatatctctctccaaagtcaccagacaacatccagacttcttgcattgccaagtcttgtgccagaccggtggcctccaccaaccaggtcccattgactggatcaaggtgtagtcttcatcttagccgtccacgcacagggcgtaagtggcgttgatctcatcataagcaggtcatggcaggaggagggtcgggcaggagacctgagtgagtgaagtggcctagattcaggataagagacggggtagggcctggactacattggaaatgccatttccaacgtaaaaacctttaacttttcctttttccccttttccttttctgctctcctccaagcctctgggtcatcaaggagggaatcgcgtgaactcctcctttatggtcttcaaggagacctactcccaatgtaaggggaagcgcagaggccttggcaagcaagaatgtaaccacaatgtcattgcctttatactgttgccatctaagtatggcaggggttctcacctaggggcagttttgccccctagggggacatttggcagtgtctggagatatttttgattgtcacaactggggtaggtgctacttgcatctcatggacagaggcctgtgaacaccctgtgatacacagcacagtcccccatcgaagaatgatcctgcccacgcggcagtaatgccaaggttgagagacccaggtttatggcaatgggtgctggttcctccaagatagacttttctttctaaataaatttattgaaataagaaagggaatgaatgaatgaatttaggcccagatttgggtattctacttataccagacttttaaaaattcatttatttattctgagacgctggcatatgggatggagcacagaggttaacgatcagccctgtcatccctttcggagcagatcaggctgtaccatttgcctcaaatcaggagcccctgccctggaagctgccatcttgccagaaacttcctggggagctgcctgtaaaaaactctagcagcagttgattctggcccaggtggaaaagctgtgttatcccaggcggagttccggcaggttgggagatgtttccaggtctcctgcccagccaggcatgatgagcatccttccaagcttggccccggagccctggcccagcacccccatttgaagcctgcagagcctcatcatcactgcccccgcccccgccccatcctgccactgacaagccaatacctgcctgatgagaggggctcccagggacagcagccttccctcctggactccagggcaacctccatgttgttgggcggctttgagcacagggctcaagggcagaggctgagttggaaaatttcttgcctctgcagaagggaagagctgggggaggttggggcctttttccccaaacgaggtcttattcttctgtggggttttctgggtttgttaggtggcttcctttctacttaaaaataagctgggagtggttaaaaaatgggaagaaatcaatgtttctggcgtacatagaactgagcagatgtgttatctagaataaggaggagaggttgttgtgactctagctcctggtacgagcccttcagttcaccctcctgccctgctcagaaccccctggacctgacatcgtggctttaacacccttgggtcatgtgagaaggaagagtgcccacccaggactttccgaggctcacagattctttgaaatggacgtgagcacaaacgcccagccccgacagccagggatcagatcgggtttcacttcctaggagggaggatgtactgcaggggaggcccacgtggctgccccaggcctggccagcctctgtgacccagcaggactgactgttttacgggatggccacacggtaccctgcaggctcatccatggtgggaccttgatgctcctttgttgagatgtgggtctgtgtcccctccccttgaatctggccagacgtgcgtagccctggtggaaggaacaccatgggacagcagaaaagatgagccagctccccctggatcactgggaccctcgctgttgtgtaagaaatcagaccccactgcaaggccgccatgctgtgaggaagcccaagccacactgaggccacatggaggtgcccactccgcagcccctcccaagctcccaaccgactgccagcaacaactgccagacaagccaaggccctgctgagccttctcagcagtggcctcagacgttacaaagcagagaccagcccttcctgccatgtcctgcgcaagttcctgatcaggagcctctgagaataaaagaaagattttaattcaccactaagttttgcggtaaattgttacacagtattagtaactggagcattcagccaattccagtcttcccaccgtgcagttattcattcattcactgaacaatattcagaaaccgtccacctcttgccccttctttgctcccacctagtcatctcagtggcctccctgtgcctaccctcatgccctgcagtctgttcccctcacatagtcagaaggattctgttaaaacttacatcagggctgggcatggtggctcatgcttgtaatcccagctctttgggaggctgaggtgagaggattgtttgagtccaggagttcaacaccagcctgggcaacatagcaagacctcatctctaccaaaaatttaaaaagtaatcgggcatggttgtcctcacctgcagtcccagctgcttgggaggctgaggtgggaggattgcctgagcctgggaaatggaggttgcagtgagctatgttcgtgccgctgcactccagcctgggcgacagagcaggactctgtctcaaaaaaaaaaaaaaaaaaaaaaaaactacaccagatcacatcacccgcaagctagaaccccccagcccccttcactcagctccgtgccgccatgcgtgccccctttccggccctccctcaggcatcttcctacctcaggacagttgcgctttctgttccctgtgcctaggatgctcttcccctaaatatccacaaggcatgttccctcccctcctgcagggatccacccaactgtcatctctcaggccttcgctacccaacctatttaaagttacaccccctcactccctagcactccaacctccctccttaggacttgatctccttgggacacgttgcctcatatgttgtgtaatttattttggtgtctgatccatgaaggattgtttttcctgattcccagcactgaagaatagggccgggaacatagtaggtgctcaggaaatctcggctgcctatctggaagaattagcacctcggctctgccaggagctggggccgtggcgtcaggcaaccaagagacagcccctgcccatgcgagcttctggtggagggatgcccctctacaaaataaaaacccaggccaggtgcagcggttcacgcctgtaatcccagcacattgggaggccaaggtgggcagatcacttgaggtcaggagtttgagaccagcctggccaacatggtgaaaccctgtctctactaaaaaaaaaaaaaaaaaatacaaaaattaggcaggtgtggccgggcgcggtggctcacgcctgtagtcccagcactttgggaagccgaggcgggtggatcacaaggtcaggaaattgagaccattctggctaacacagtgaaagcccgtctctactaaaaatacaaaaaaattagcgggcgtggtggtgggcacctgtagttccagctactcaggaggcggaggcaggagaatcacttgaacccaggaggtggaggtatgcagtgagctgagatcacgctactgcactccagcctgggcgacagagtgaaactccgtctcaaaaaaaaatgaggcaggcatggtggcgggtgcctgtaatcccagctactcaggaggctgaggcaggagaatcacttgaacctgggaggtggaggttgcagtgagccaaggtcatgccactgtactccagcctggatgtcagaggagactccatctcaaaaaaaaaaaaaaaaacacgcacacaaacacaaactcaggccagagagtaaatagaggaatcacaagttatgataagtgctctgaagagagcagtgctgggactgggggtgggggtgaccgagcagggcctgcttcagggacagagggccagggaaggcccaagtcacagccagggtggccgagtcaggtccagaatttgtgattcccacacccacgttccttccgcttttccacactaccttctcttatcagttgtcaaagaaggatgggcgagttggccctcagtaaggcggagagttgggcacaggccaaggaggcctagcgtgggctggtaggccgtgccctgaggcctctgttcacacaggcacgaggtggccaggaagccacgggagtcagccctctgcctccagcccgccccccaatttgggttcatttggttgcaagtgagagagcaactaggaatgacctaattgaaaaaagggaatttcacttctgatcttgaagagtcaaaagtatggggaaactgacctacaaagaaaacagaaactagttaaagaggaatttattgggcctgaaacaaagaacccaacccaaatcttcctctttcaggctgggctggatcccaggtgtccagtgctgttaagtcccaagtatggtgcatttcacagcactgctgtgttcggtgtgttggcttcattcccgaccccactcaagacaaagtggcgtcgctgtcttccctggtcctcacattggaaccacatggagtgagttagccagttgtaaagactggatgcctcttcctgaccagtcaggccaaagggcctggattactctggcccgtcactgaggcaaggggtggggaggctctgattggcccaggtctaggatcccacgatctagcattgtagctccagaactggagcctaatttgaactttgtggaccaagggtggggagaaaaggatcccccaatattttttttttttttttgagacagagtcttgctctgtckcctaggctggagtgcagtggcgtgatctcagctcaattctcctgccttggcctcccgagtaactgagattacaggcacatgtcaccacacctggctaatttttgttgtttttgagacacggtcttgctctgtcacccaggctggagtgcagtagcgcaatctcggctcactgcaagctctgcctcctgggttcacgccattctcctgccycagccttccaagtagctaggactacaggcatgtgccaccacacccagctaattttttatttttagtagagatggggtttcaccgcattaaccaggatggtctcgatctgacctcatgatccacctgccgcagcctcccaaagtgctgggataacaggcgtgagccactgtgcccagcctaatttttgtagttttagtagagatggggtttcaccatgttggctaagctgatctcaaactctggacctcaaatgatccacctgccttggcctcccaaagtgctgggattacaggtgtaagccgccacacccggcctcagactcccaagaaaattgggagctgttatagaaaggagataatcctgggtggcccaaacctagcagagaacacaagccagcatttattgggcacttgctgcatacagatctgttgaaagtctccgtgcatgttaaaccatccactctgtaggcaagtgcttgtaggtgtcctcactttccagatgaagtcactgagaagacaagaggttcagacacttgcccaacctctagtaagtgacggagctgagatccaaacccaggcaggctagctctagatcctaccctcctcctactcagcgtgttccctgtggcattttcccccaagtaagtatcaggctgtttgcttacctctgtccgctgtttgtcagctctctgagaatcgagagttttgtctgttctttttttttttttctactgatcatgaaacagtacaaagcaagtggcagatgctcaggtatttgagggtgtgaattatatggcctgtcaaacatctacccacttgacatacaaaacattttggtgctcagcttcctaagacttgaatacattgtttctaaatttcctttgtgctctaactttaatccatggccactctgttctcacagcttgccggtggtttgccattatttccagtcctcttttctgatcattctcacatgtagctggaatctttcaactccagcttttcctatgttgacttagagtatcacttccaggagggcagggagctttcttttcactgctttatccacagtgccaagaactgtgcctggcacacacgagccttcaggaatgtcttgttacatcaatagttaggcaggtaactgggttcctaagccctgcatttttgccctacaatctttatgccctaatttcctttccagatcctgagcctttgtcttgaaacctgatctttccctcctccctctgaatgacccttctattgtctcctgccctgttcttgagagccggcttggttctctgcctccatttggaattccaagaacaggcaaggagagccacaagatggcctgggctaggtaggggagacagggagaagctgtggcccataggttacaggagcttctgtcctttctttgacggccccaaagaggaggagagaaggctggagaaagcctgtagccaggaagaaagggagacacaggggagtgtaaagtttaacagatgtgcgtgtgtcatcccctgtctagacagcttctgggcttgtgaggtttgggaccacactttcccatccctccaggggcctctctctgtttcctctgcctgctctttgcccaaactgtttctcctgcctgaagcatcctgtcctccaccctcctcttcactggccatccaaatcctttggattcttcagaactttgctcctgttaggctgctcagtttatgctaagtactcctccaggaagccctccctgactgctcccaggccagcagtttcccctttcctcttgctgtttatacaacacacttaacctcagtcccttgtatcacttgttgctttccaagtcagcataagtgtcaaaagagtaggctctggggtcagaatgtctgtgtgcaaatagccatgctggcttgcttgttttgtctgtcacttggaggtggcacatccaagtgaacctcccaggggacagggaagagtggattactgttgtaatcgggcaggattctcctatcactgaacactgcctcacatatagcaggcccttaataaatatttgtaaagtaaatgaaggaagagagaaatgatcaggctccctggaccacctgaggaggccctcaggtctgttgctgggctctggccccagcccgtgggacatatctgcacacccacaatttcctttcttccctcctctcatgagtgtttcccgtctgaccaatgccgccttctgcctctggccccttcttcctctcccaccacctcaactgcctaattattaccaaacttctctctcctgttttttttgttttgttttgttttgtttttttttaaggcagtgtcgctctgtcacccaggctggagtacagtggctcgatctcggctcactgcaggctccacctctgagttcacgctattctcctgcctcagcctcccaagtagctgggactacaggcgcccgccaccacgcccagctaatttttttgtattttttttagtagagacggggtttcaccgtgttacccaggatggtctcgatctcctgacctcgtgatccgcccgccttggcctcccaaagtgctgggattacagacgtgagctgccgcgcccagccctctctcctcctcttgttggatttggaggtggagagaagatgggaagggaggaccaaagggacagtattcagcacccatgctgcacgacactgggcaggttctggaacctgtccgtgccttatcttccttgtctgtaaatggagcatcccaactcacaaggtggttgtaagggtggcgtgaggtcacacactaaaagtgcttagaattgtgcagggcccctgatgttagctatcattcattattgttcttctagggtgtttcctgtgttggtctgggtgctccctgttgcaaatgacagccctaattcggactctcttaagcagcaaagggcacttttttgagtctgtacctggctacaagatgcaacttggtccaccccattgtcaccagcatcctctctctcgggctccatccaatgggcggccaccatcagcaccatattcatgcctcctggcacccagcacagtctcctccagcctccaggactccctctcgcttattggccagacttgggtcacatgtctgccccaggaccaatcgctgaagctagagctggaattgctgattggctccacctggctcacatgcgctgccctgcagtcaaaccatatataagggggggtgggaaataagagcacttgtggcctcaaagcactaacaggggctgttaccaggagacaggagataattctttgttaagccagtaaatattttgaatgcctgctatgccgcaagcattgttttaattgttgaggatatagatctgaacaaaaatgacaaaaacctgtaccttcagggggctgatattctgctggaggacatccgcaaagaaataaaggagctagctgtgagaggtggtaagtgctactggggagggcagagatttcggttttaacctgccaaggtgaaatttgagcaaagacctgaggagggggaagaagggatggtgaagataacctgaatgaaggctccaggcagagggagcagcaagttcaagggccctggggtgggctgtgctagcatgtgcaaggaacagtacagagaccgtgtggctggaaccaggtgtgcaagggagagaggggaaggcaataaggtcggagaggtgatggagcaggttgggtgggttcttgtagcccctttggagggtttttgcgttttactctgcgtgggatggaagttattgaaggccgttcagtggaggaaggcaggccctcygcttttgttttaacaggatctgtctggctgcttgatggaagggacgaggtagaagcagggaaaccagttaggaggctgttggaatccaggcaggattctcctatcactgaacactgtgcctcataggaggtccttcatacgtatttgtaaagtgaaagaaggaagagagagaaatgatcaggttctctggaccacctggggaggccgctaggtctgttgcggggctctggccccagcccgtgggacgtatctgcacacccacagtttgctttcttcccgcctttcatggacatttaccatctgaccagtgcctccttctgcctctggccccttcttcctctcccaccacctcagctgcctgattgttcccaaacttctctctcctcctcttgttggatttggagatcctcagaggaaaacagcccatctgggtctttctaaacaggtctggatgaggtcccaggtgtttgttcaccgctgtggtttgtggcattgggaaggtgagggcatcagtcactcagacccgttcctcttggcagatcggcagagaaattgagaactaaaaatgatgtttctaaatgctcaggacgttagctgtttccagagatgtctcctgggctggcgagcctttgccaaggtcctggagaagactcaggatggagaggaggagccagagagacctggaaaggaactggtgggaaggagaggtgttgtccacagcagggatggagtggcaggcggctggtgctgcgtgagttcactgggtgctctctcggttcagccactttgaatattttaccaagaaaaaggaaaaaaaacaaggcagaatcccttgtgtcatctttaattgatttcttcagcatccggagagaaactggcatgaggccacgagaagtctgagccaggggaattcatcagaaatcgacccactgatgacttgatctgatgaaataattagctcctgttattctctggcttctggtgccggagctttgacttccatccagaggagagcgggtgatagccgcccaggagtggggggtgctctgaaaccaacatgggagccaggaacgaagtccagctgactgtgccccgggctccatctttacccagcccagggctcccaatgaagactgcccttcccagcccccctgtaccctggcatcacaggcccagggccaaaaaggccctcagagggcacctggccacctggcaaatgaggaaactgaggctgggagactcttaggaacttgttcaaagatctgcttctagggggtcctggttgagctgcccaaatcgggccagactaggtttgaaccccttctctgccacttacccatatgatcgggggaaagtgattttaactctctgtgcctcagcttcttcatccataaaatgggtgaaatattgatgggtgggtgtgcatattaattgggttgacacctgcaaacagctcagagcagagactggagtgtgctgcaagctttcagaaaggttttcctgtgattggtttctggtttcagagagttgctatttgtagggcaccccatcggaattctcccaatattagcactccacgtctgtctctctgaaggaacgtgaatgtgcatcttagaacgctggctgctgcaatcgtagtttcaagtgcaaagcatcccgtagtgtttcccgatggagggacatgggccactgataatgtattagtctgttttcacgctgctgataaagacatacccgagactgggtaatttaaaagaaaaagatttaatggactcattgttccatgtggctggggaggccttacaatcatggtggaaggtgaaaggcacgtcttatgtgatggcagacaaaagaagatgagaaccaagcaaaaggggaaaccctttataaaaccgtcagatctcatgagacttattcactaccatgagaacagtatgggggaaccacccccatgattcaattatctcccaccaggtccctcccacaacacgtgggaattatgggcgctacaagtcaagatgagatttgggtgaggacacagccaaaccatatcagatacacaacatagtttgaggattactctgatttggggtggttcagggactgattcgatggctagagtttgtctccttttcagctgtctggcagcctccagttacctccagcagaaagtctcagatggtgctaatgtgctttgactcctttcaacacctgctaatctcacttcaaaagagagtgcgagcgcgagggcacgcgaagcctgggaagctatttgcatcaagttccactgattcagctttctttgacttttatttgtacaattagctctacagggaagcgatgtccactttccatttatctttgggtaggaagttttcttttcccaaaacatgtgtttgtgtttttattttaaaatgaggccatttaaagaagcacgttaagcaaataatcactgaagggctctgcagattcagcagaaatcagggccgtggtccttgaacggaaagagttgggaaatccgagtttcgtgatgagaagcccacattgaacggtgagggagggcagaattcacatcccatccctgccatcttctgtctgggtggccttaggacagtaatgaaacctcagttttctctggggctaataatagtacttgcaggagggagccttggtggaggttgaaggagatttcagagtgcctgacgcaggacagctgcagcggtaggatcactctaataatggtttacattgtggaatatgtatcccagttagtactatggccaggctctagtcccagcacactgtatcaacacatttaatcctgcacacccatttcacagatgaggaaactgaggcacaaaggtgttaagttactagctcagggtctttcagcaagtaactccaaagtccacatccttaaccatcacaccacgtggcataaagcaggtgcccagcaggcagttgccgcagtggctctggctgtcatgaggtgtatgtttctgcagacgagagattgagaaggaaggtgttgttcaccctctggtcccatgaaactcacagttctcatgtcagacgactgcatcgagtgtgtccccagctcccctgaaattgtgactctcagagccacctgggaaggaggcattgagcggagcctgcttcctgctcccaggggaggtgctagaagggagacttgctgtcctggccagcctgacataggatacaggtccctgaatgaagtaaattagggtgcgcatcagggcagctgggagagttgattgaaagcactgttttcagaggcaggtgggcaaagggagcaaagaaatgatgctgcaccgaggaaccggtagcaacaggagcccttactttcccgagacttgatggggcaagaggagggagaggtgaactcagaactggggagacgctagagccaggaggggccccaggcaggagctgcatccacacacacagacacgaaggctactgcctggggagctactgcgtgcgggaggagaataaatgcacggacttcccaccacctcccatgctgcagcctcccagccggaagccagagagcagggacgtgccgaccgtgccatctgtagagctcagcctcccagggtgccaagcagagctgggggagaaatggagcaggagtgacccttcctggggtttttcaaccatagcgctgcccagagaacacagtggccagctcctcgttggtgtccatggagggtggctggggcaaggcatcagtgatggacgcctctgagccatgtagacccaagctatggcacggccctgccaagtccagcttccctcactctgcagaactcaaaggaccttagcagaacctccgttcctttatttatctatttctttgtgccaaggcctggagacagccatgaataacataagcctgtctctgtcctcagggagctgaccccctagtggggaagaattggacaataaataagaaattgcaggctgcagtagtgattacaagagaaataaaaccggttataaaatgcagagtgcctgggttgggggcccccgctttaaatagggtggccagggcaggcctctctgaggtgatgacgtttgttcttttgacagaaagagccaggagtacaaagcaggagtttgttgttgttgttgttgtttttgagacggagtctcactctgtcacccaggctggagtgcaatgacatgatctcggctcactgcaacctccatttcccaggttcaagcgattctcctgcctcagcctcccgagtagctgggattacaggcatgtgccaccatgcccagctaatttgcgtatttttagtagagatggggtttcaccatgttgatcaggctggtctcgaactcctgacctcaggtgatccacctgcctcagcctgccaaagtgctggaattacagatgtgagccactgcgcacagctgcgggagttatttttaaaagagcaggtgcaaagaccctggggcaaagagaagcttgacttgtccattcgacagaaagaagccagtagggctggaaaggagaggtcgaggagaagtgggcaggggccagatctcacgggccagggcagccctggcaagaagtttgcatcttatcctgtgagccatgagcagccagggaaggtgcggcaggtgagcacaggactggcactaaggtgaggcgagtgcctggcacttgtgcagcctgggagcgagcacccccttcagtctgtacctgcacgaggcactgtgccctcccctgcccagtgctgtgatctgatctgtattttaggaagattcctccggctgccctgggaaaatggaggatgggggcagggaagagggaggcgggagacccctcaggccaccttgcagtccccaggagagatgaagcaggcagcacatccccctgctgaacccggagaccttgctgagcctctgagtcatgactttgagctgatggctggggttccccatgaagggcaaggacaaacagaccctttcaaggtcacagcaacacagccacccccacagcacttggcttcctcccggcacatctgcaggctgtggctctctcgctcatgctctcttgttttaaataaatgataccaaaagtctatatctggacaggacttgaaggctcatttcctcaagaagtgaaaaaatgaccacggagagcaaagagcagggcgagattagagacctgcttgagccagagtcgcgtccccacctccccgcacccaccttcgctggtgacctagtctgacctggggccaggggggtgactgagggcacagtggcctgtggcaggtcttccccctccaccttttagcgctcaattttctctattgtcatttcatttattctgcaacttaaaactaataggctgggcacagtggctcacacctataaccccagcactttgggaggccagggcaggtggatcacctgagttcaggagttcaagaccagcctggccaacatggtgaaaccccatctctaccaaaaatacaaaaaattagccgggcgtggtggcaggcgcctgtaatcccagcttctctagaggctgaggcaggagaatcgcttgaacaccaggaggcagaggtcgcagtgagcccagatggcgtcattgcactccagcctgagcaacaagagcaaaactctgtctgggaaaaaaaaaaaaaaaaaaaaaggaatacttttttgcccaactacaagatcccttaacaaggggctttcacacgcatccccagcagactgaaatcttacaacagccctgtctactcattttgttcatggggaaaccgaggttccaaacgggcttgctcacgggaaaactgagccagtgagtggaagatctgccactcacacatgccagttgtccagcccaaaacatccagctccaggctctcgtttaaacccctgattgaatcccccgctgctggggagctggaacttcatctccctcacctctgtaccccacggtgcgggcagatgcaagaggacggcaaatattcaccccttgagaccagcccgctgctgttcctctccctggggacgatttgtctgtggagttgggtggattattcagagacggctgttatctgactcgggtcttgggctgccaccgacacatcagaggctcactggatccagggaagaaattgtttctgcagaagtggccacagaaggcttttctgccagtctgttgaccaagcaaactgtaaagactttgctaacttcagcggagttcggttttcactctgccatagccacccctgttcaaagaaactcccattgttcatgccagccgccatacaaatcattatgcaagaatgagcagccggcagccttgacataaatattgacctgattcttcctcctcctctagatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggtaagcctcggggccccagggtggcacctcggcccctcggagcagggtccctgggttaggctgaggctcctgaggcaaggcggtggtgttgatgcgtcgtgctcacttttgagtacattgaaaccaagacacgggccacccacacgtgtttggggtcacaactgggtcctcaaggttaggggtctctacccttctccagttgcacaaccgttcctggatttctccaaagagttaaagagaacaggctgggcgctatggctcatgcttgtaatcccagcacgttgggaggccgaggcaggtggatcacctgaagtcaggggttcgagaccagcctggccaacgtggtgaaaccccgtctttactaaaactacagaaatgagccaggcatgatggcgcacacctgtaaccccagctactgaggagactggggcacaagaatcacttgaatccaggagaaggaggttgcagtgagtggaggtcatgccactacactccagcctgggtgacagagtgagactctgtctcaaaaaaaaaaaaaaaagatgagacatgagcctggagccaaattttggaggctcttgtgggttgtggcaaagactgtcaatcattgatcccgtgaagggtgatccctcagcctctgtccactcttaaaggataacagcgtgttgttggtggcaacaaatgtgaaggttgactaggttagccttgacaacctgaatttgtcttttagctaccaggaaaaggcaatttacataaaaccaagttgttccttgcaatgctttgtattaatgatcacaagtatagtttttttcctccgggagcttctcagtgcagaaagaatttgtagccaggaagcaatcagagcccagagcttttattgacaatttgacacataggatacctatctcctggcagcatttagaatgaggcgcatttgataactatggggagtctgcagactgtggccagagaggtgtgtttcgtttcttgaagaattttgcagaggggtcttgcaggcagcacctggacctcagagcttcttggtctcacattgtgtagccccgacgctgtttcggctatagtcatgcttagaatttccgatgccctgcacgtttgttcattcatccagcagatgtttattacgcatttgttgcattcagtgcactgtgtcaggagccagagaactaagggaggctcattccaggtgaggagaacaggaaattcaaagatactgagatagaaatgggctcggtggtttggagcaaaaaaaaaaagtgccagggagccggagtggagggagctggggccgtgatggagagagatgaagctgaggagctgacttggcccgggttgcaccaggccttgtggccatggtgggggctttgagtttgattcttagtaaaatagacatggatgagggggccttaagaagaggaaggccgtgacctcacttaggttctaacaggatcccccagctcttttgatgaaattaaatcgcaggggtaagggcagaaacaggacactcattcagaggccgatggggtgatagggcagtgatgatggaagctcagacccgggtgctgagatgcggtcccacctgatgtatatttgggaaataaactgatcaatgggttaggtatgtgggttatggaaaagatacgtttcaagggcagccgctagatttggggcccgaatcaacaggtgagtggctgaatacccactcttaggaacaacacatttttgcaacatgatccagctaagtctcatgtctgaatctgactgaattttgcatctgtgacttgtgaataaaaccaacagtgtatgcagataaaaagaaagcaaaggcatatgcagatataaggaaaccaacagcgtatgcagatacaaggaaaccaatagcaggtatgaagtagacacaggagagaggggaacaaagaaagccgtggctgacttaaaatacagagatttcttctctccatttgacagatggaaaaactgaggcagagagaagtcacttgtccaagtttgcacagctagaatgtgattaaacatgatttgagctgggtgcagtggctcacgcctgtaatcccagcattttgggagcctgaggatcacttgaggccaggagttcgagaccagcctgggcaacatagtgagaccccccccgtcttaacaaaaaatgtaaaaatcagccaaggatggtggcacacacctgtagtagcagctaatgggaggctgaggtggaggatcacttgagcccaagaggtcaaggctgcagtgagcctaggtcacaccactgttctctagcctgggcaatagaacaaaaccccatcttagaaaaaaagagaaaaacaagatttgaacccagaacgcgtgatcttagccactgctctatttagccagattcctgggatggatattgagttgttttcagattggtagcgtgtgcgtttgttagtttttcactgttacggatattgttgctggaaatttaaacaggcatcgttgcacagacaagggagtgcttctgaaggataaattctaggaggtggatgcggtgggtttagagcccctggtgttcagtggcctgtgtcagctcttgcccaatagcactacacagcatagattagggcctacaagtcttgccctctataaacaagccagacctcttccaccagcagcactgggttttgaaggaggcaagggatgggaaggtggttgtgggaggggcatgataggctttttataaaccactagacagacccagatcaataatgcatgtcccaaaaaagcccaatacattatctcacagtctctgctacaactggcatgcagcgggtggtcctaaaaaatttatcatttgctattttctgcccatccgtgcagcagttctgacagccctctgggctggagacttcttgactgagataatcccaggattctttccagtcccaggacagagaacagacgtccatcctcattagggtccggttgggaggactggtgccagatacacaagacgaggggcttgttctgtttcctaattgcaaggttggggggttcggggctgtaccacgtatattcaattttcctttccctgcacgcatttgactccctaagctgtcatttggaattatcaaatgcccaggggaactgcttccagggccatactagttcgtaagtggcctaaattatcattacatgtttaaagtagttggggacatccctgtgtctcaatggccctctgagaccaacggacttttgctggacttccgctccaaaagaataagagggaagcacatggaggtaaaggtctcgtttgcagacgtcctttgttcagggaggcagtagaatctttgggctctgccagggtttactgatttaatttgatctaaacctctggggagcctctggggctccagcaggctctgagacagcaagaggattaagacatggttctggcctggagcaagagaatttttgcagcatcccagttctgatctatgacttgagaatttctttaactggacttatttttgaagcttaaatattattttaaaaggaacctccaaattctgactgtaaaggaaaaaaccaatacccattgccttcggcaaaggatcactgtaaaaccaaacacagtgaaaaccaagtcgtgtttttaaatttcagcaagatgctgcctcccagaaagccagtgtgtctctactgtaatgagggtgacgggcagtttcagaagcggcattaaaggtgaagtagcacctgccaagactttcttcttggcctcatcagcaggatagagactagaaaagagaagaactttctcaagcttttgatgtgggggtcccacttacatggggaccacttggtggtggctcttgtatcagagggttaaggacacagccagactccaaaccccagaatatcagagcggattccccagtgctcattttcctgagtgttcacaccaggcagagatgggtgccttttcgaggcccctcagattgtcggatttgaagtgtgccccacgagactgcatccagtgtttgcatttcttttcttttctttctttttttttttttttttttttgagagagtctcactctgtcacccaggctggagtacagtggcgcaatctcggctcactgcaacctctgcctcctgggttcacgtgattctcctgcctcagcctcccaagtagctggaattacaggtgcccgctaccacacccagctaatttttgtatttttagtagattcagggtttcgccatgttggccaggttggcctcgaactcctgacctcaagcagtccgccgcctcggcctcccaaaatgctgggatcgcaggcgtgagccaccacacctggcctgatgtttgcatttcaaaagaattctttgcctctcagaacatctttatttttatttgtttatattttttgagacggggtctcgctctgtcacccaggatggaatgcagtggtgtgatcactactcactgcagcctcgacctcctgagcttaagcaatcctcttaccccagcccccgaagtagctgggactacaggtgcgcaccatcacactcagctaattttgggagtttttggggttttttttttttttttttagagatgggcttttgccatgttgctcaggctggttgcaaactcctgagctcaaacaatccgccccccattggcctcccaaagtgctggaattgcaggtgcgagccgctgcacccagcctatcagaacatctttaaatgaaaatactccgagtaaagttgcaagggtaagagctgtctcattagccaccaggttcaaatcctcactctaccattgaccatgtgtccttgggaaagatttgccctctctgtgcctcagtttactcatctataaagtggagatgatgatctgtttccctggcattcttgtgaggaatacctggcacctgtcatatgtgtgacagtttgctctcacttgggttgttaaagccatcctctgttagagcaccctgggccaatgccacagtgttgtttgtctacagcaagctttgcatatcaaaacgacattaaaatctaaatgtctcatggcactgaacagcaacattagagtctcctcccagctgacacagtggggtgagtgctgtccacgctcatgcaggtgagctggcacccactctgccaggtatgtgagcctggcatggttacataccccataatttgagtgacacttgtcaatcaagtttggcatgggttcttctgccattactgcctctgctgatgaacagagttgcaccatcatggctgttgaaaagcaactgagtggtggttttggggcctgcaaaagtgccatgggaaccagccttccactgggtgttaaaaacgcgtgtgtcacaaccactctctgtcagcctggattctctcagttacgagtgatgtaaacccaactcgagcaggattgaggaatcaaaaaggggactttattggactcatatgaataagtccaagtatacattgagcttcaggtgcggctggatctaggagctttgtctctgggtggcctctgtccctccatctccctgacctcagctttcctccaagttggctttactctcaggccagctctccaggcagcattcctggcatcactagacccacatgaacaccatacaggtgcaagccatccctgtggaaagagagcttctctcacctagaagagagtacccaaattgagtctttttggtctgacactgtctgggacttctggtcaaccagattcaggggaatggaacacagtggttggccagatggagtcaggtgcacattcctggagccaggactggagccaaccccacttgaaccatgaggactgggattgggatagagcagattccccaaaggaaaattcagaagctagtgccagaagaaggcaggtagctggtgtgcagtccagttagagagatgctcgtgacaccctcacatggcgctctctgaagcagctgctcaaactgtggaccagacttattcattcggcaggtgtttcctgagcacctactgtatgccaaaggagatccaacagcaaacaaactaaacagagcttacattctaatgcaagagttaacaagacacatcgaatctatagtacataaaagagcagaaagtgaggaggagaataaagccaggaggggaagccaggaggggcgatcaaccaggagaaaggtggagaaaagaatcgctgggattttctatagggtggtctcattgggaaggggaaatctgagcaaagaaggtaaggaaaccagtcaagggggatccctggggaagagcactccaggcagagggaacggtgtgtgctaaggccctgaggcagatgcggtctcagcaggctcagagccgcaaagaggccagagcagcgtgcacaagagcagcaggaagaatgaacggtaatagggaggtggtggttggatggaccgtgcaaggcatgagcctttgaatgggaggaagattttggctttctgagtgagatggacaccaatagaggacattgagcagaggaggacattgagcatctgatttgtgtcttcataggacccctctagaagaatagactgaataggtgtaatgagagcagggtgtccagtaaggagtctactgcaacagtccacgcatgagatgagcccaatgaggagtctattgcaatggtccaggcatgagatgatagcggttcagaccagagtgaggaaagtagtaagtgctggtcatatttcaaaggtagagctgatacaagtgctgatggaactgatgagggatggtaaagaagagttgagaatgactccaaggttgtggcctgaaaaactatgagaatggattttctgtgtacagagatggggaaaaccatggttagaagctgtgggccgggtgcggtggctcacacctgtgatcccagcgctttgggaggccaaggcacgcggatcaagaggtcaggagatcgagaccatcctggccaacatagtgaaaccccatctctactaaaaatacaaaaattagcggggcatggtggcacacgcctatagtcccagctactcgggaggctgaggcaggagatttggttgaacccaggaggcggaggttgcagtgagctgagatcgcgccactgcactccagcctggcgacagagcgagactctgtctcaatacatcaataaatcaataaataaagctcagttctggacctgggaagttgcaggtgcctgtgaaaagccaacaggaactgtccaataggcagccacatcagtcagacgttgaagagagaggcccaggcctgggtggacttagagtagggcacggtggggatcgtatacaaactgtgtgcttgtttgtgctttactgaatctgagaccctccccagatcctgaaagttgcaggaatacagcctggagaactgtccagtgggagaggcaggcttttgaaagaaagatgtagcagaggtctggccggcctcctgttttccactttccatctgtgaacacaaggaaaccacaccctgtgccacagcctgatatccaggagatcaattccaaatcgcaggctcaagtactctctgtaggggccagatggctggaagcccaggacaacatacccagattccagacaccagatcagtggtaacttccagctcagcctctctgagatcccacctcctggccttctagccgctgatcactagaggagaaaaaacatgtggatgcaggttatctcaggaagaagagaggctcattcggacccacactggtgttcagcttgccaagcacattcctgtaagatgattttttttcaattcagcaacatttgggagatcacttgagttctggaagttaagtgtatcaggattaggtttggctgcatgtaaaagaaaacataaaataacagtggcttaaacaagacagaattatacaaatgtctggaggtaggcagtctagggctggcttggtggcttcaaggttatcagggacccaagctccttctctgcctttctgttccatcatacttactgcgtagcttccatctgcaaagtcaccttgtggttagaacagctgctggagctccagctctcatagccacactctaggcagcaagaagaaggaagcagaggcagaagggcaggaaaaagaaaaaaaaaaaaaccacttcagaagtcacatgcaacacgaatagatcttatttacttagccacatgatctcagcgagaattataaagcacatgcaaatttgaatcattggaagacggtttaagtgttttttgctaaggtgtgagcaagtgcgaggaaaccactagggatagggcagtgccccaggctaattagcaacagtgggacaagaggttactggaacccagggacacagagggtcaccccacaagagctgtcaccctctgttggcaccacagagaggaaggtggaggaatctgtccaccaacctcactctcttctttctccgatctcctgccaggggcccttgtcagtcaaatccaacccaaagcccagagagcgaaggggcttgttgaaccagcacctccaggccagtgccctggggtggagaactggacagagagcagggctggaaggcggcaggcaggctcctggcacatctttggccataagggaatctgggaaatgtttcctagctgggtgcattgaaaataaagtcacagcctgatcagaggaagaaggagaaagagatatttgtgggcaactgagggtctcagcaacaccagagatcaggagcaagggtcccagtgagggcagctcccctagcagtgggaagtggggttgtgtggcctaacactggggagacctgtgtcatgaggagacattcatgtggaaacccgaggcaggagcactgcaggcagaagcacggcacgtgcaagagccctgtggcaggaacaggtttcccaggacgttggaggagggcagcaggacatgggaatgaaggggaggaggatggggaagagggcggcagagagcagacaggggagacctggtggtccccagcaggccatgcagcagggtctggatttgattgcatgcccgatggaaggtccccagaatgttctgagctggtcagctatgcgtgcatgttctcagaggcacaccccggctgtaggtgaagagggtggcccagggacaagagcggaagcagggagatcaggtggtgtttgcagcagtccaggtgggagatgctggtggtacggagcaggacggggcactgcagagcgagagaggtgggtggattccggtgctgcttggaaggtcggcagggtttgctttatggatcgtgagtgggtgggtgagggaagaggaatcggggatgactcctaggtttttggctgagccgttgggcagatggcagtgccatttacagagatgggaaggcgggggcaggaggaacagattgggagaggtggggaagggggggacattaggttgctttgcaaacatcacccaccaggcctgtggctgggcagcagctctgcgtagccccttctgaaaagtggggaaaacaccctggaagccctgccccattgaataaatatcccctcccagggatggtgattgtagcattttgagttagaggaatatttctgggtggagtttctcagagaggaaatgaccaatcattgcagagcctcgtcaattacacccaagccctgccctttcccacgtgtgctctgccacctctctgctatggttgacgatgaccatagcagaattttctcccaggaacttctgcaaccagaggcagcagaaagcaacggagaaaaaattaactgcatggtctctctgacaacccgatgcttattaatagaatctcagtcctgcctcctcgacatctgcctaattgattttgggtttaggaaccgatttggagccttggcttttcgtagctgaaaccagcaataacatttgtctttattttgtaatgtccaagagtcaggaatggttcacctttgcaccaacaaaagaaaaacaacaacctctgagcaacaggtctccagaatccagtgtaattattctggattgagttacaggcacagcaagagttgccaccagcagcagtgagcacatctatactaggtgaaaaataagagattccctttttatgtgtgtgtgtgtgtatatatatatatatatatatatatttttttttttttatttatttaagttctagggtacatgtgcacaacgtgcagttttgttacatatgtatatgtgtgccatgttggtgtgctgcacccgttaactcgtcatttacattaggtatatctcctaatgctatccctcccctctccccccaccccacaacaggccccagtgtgtgatgttccccttcctgtgtccaagtgttctcattgttcaattcccacctatgagtgagaacgtgcagtgtttggtcttttgtccttgtgataatttgctgagaatgatggtttcgagcttcatccatgtccctacaaaggacatgaactcatccttcttttgcccaagtgtggctcccgatttctgctgtttgtgccccaggcctttctctcccctctgctggagacagagctattctggggcagttggtcaggtctgatggagcccagcctgctgcagcccattagcaggtgttgccttggtcatggcagggagctcacaagctgatcctacagcactgcggacattccagggacatttgagggccaggagagggctgctgaatgagttccagcctgttaggtggacaccagtagccagaggtcagtgcaggacacaggttctttcccgcctgtggctcgacctcatagccctcttcatcccccacctgtccaggtcaagactctgttccaacctgtacctgaccccacagcctctcttccccactgaatgcctgttctctgcaggtctctgggccccagtagagcgttacctttgcagatttatttagctgctcccttcacttggaattgaatcagctaagggttgcaaactccatgcccacagggctaggcacgtgctggcaaggaggaagtcggcatggtaggggtggtggaagaccagaggaggaccttgtcaagtgggccttcgctactcaggtccagcccactgtgggcccatcaaagccaggtctttgcatttttcaagcaaagccagaaagctgaattgatgtgaaatctcgcaattaaagaaaaaggccattcaatttttaaaatcctttccttttgggcagacctaaatcaaacacacatgcagacaagatttagtctagagggactccgttttttaactccgcgtgagacgatacttgttgaaaagctgacatgtggccgggcacagtggctcactcctgtaatcccagcactttgggaggtcaaggcaggtggatcacttaaggccaggagttcaagaacagcctggctaacatggtgaaaccccatctctactaaaaataaaaaaaattagccgggaatgatagtgggagcctgtaatcccagctactcaggaggctgaggcaggagaatcacttgaacccaggaggcagaggttgcaatgaaccgagatggtgccattgcactccagcctgggtgacaagagagaaactctgtctcaaataagtaaataaataaataaaagctggcatgcattaagtgctttctgtatgtcaagcattgaactaaaaaagtgtgtgtgtatgtgtatatatatatatatatatatatatatatatatatatatatatattttttttttttttttttttttttttttttccctcaaaactcagaacaaccctgagaaggaggcactgttattctcccgctttgcagatggggaaactgaggtgcagggtggctaaatcatttgcacaaggtacctggttaataggaagtggcagaaatcaagatttggaatcaggccttctgactgaaaacctttttcatcctattgagtatggtgacatagcgataggttctagaatctatcctagaatttcatagtcaaaccttatacctaaagttatttatgggctgtgtttttacagacagggaagctgaagctcaaagtcagtgatttacggcagttcacacctcattcttggcctctcaattcagtgctctttggcacccaaagtctacagatgaaaaaggacctggtgattcagtctaggactgaagtgtatatgtgcatctgtttgtgtgtgtgttatacacacacacacatattcatttgtagcagctgaacccttttaacatacaaaacaaaacaggtaagagaggaatcaggagaaggacgcggcctggagaggggtgtgtggtgcccccttcatcctcagcctgccccatgccaggtggactttaatgcccctctcctcaaggaaagaaagcacagcttgggggcccctgggagcagactggccccaggtagagtgtagcaggtgatatgtggccacaacagtggccacagtggataacagtgttatcccaacactgggaggccaaggcaggaggatcacttgagccctggagttcaagaccatctatagatttttcggtcatctatagaaagcccactgtgtgccctcttcccctaaatcccagggcctgcttcacataggggtagcacacagacaggcctgcagacccgtgcaggaatgccaagtgccaaatcctgccctctcccattgttctagaaacctgtggccctcttgctgcatttatttattttttatttattcaggagttcaagaccagcctggtcaacatggtgtaaccctgtctctactaaaaatacacaccaaaaaaaatagctgggcatggtggtacttgcctgtaatcccagctgctcgggaggctgaggcaggagaatcgcttgaacccaggaggtagaggttgcagtgagccgagatcgcgccgctgcactccagcctgaaagacagagggagactccatctcaaaacaatcaataaaattacacaagcaaaactttaaaatatccaagtaatgcaaagcagagatagcccttgactccccacccaccgtgtaccccactcaccccaaaggcacctgcatgtcccctaagaatctgtagcctgcatgtcccctaagaatgtttactcttcatttactcacacggaagcaccaggaagagcagcaaaaggcaagaaggaaggggagggcatgattctaatcagcacagtccagagaaagccttgctgagaaagtgatatttgcagaaacctgaaggcaatgagggactgagtctgggctgaggagtggcaggtgcaaaggtcctgaggcagaagcgtgcttggtgtgttcgaggaacaacaaggaggaggtcaatgtgactggagcagaggaagcttagagagagagcgcacagtaggagttgtagttggggcgagtgagcatccggatcactgaggaccttgtaggacagagggaggactttgatttttactctgagtgaggcgggcagtcactggaagacaaagagcaacgaatatgatgatttcactgactgttttaaaagaagtcctggccaggcaggcatggtggctcatgcctgttatcccaacactttgggaggccaaggaaggaggatcacttgagcccagcagttcaagaccagcccgggcaacgtggtgaagccccacctgtacaaaaaatacaaaaattagctgagtgtggtagtgtacacctgtaattccagctactcaggaggtggaggtgggaggatcacctgaacctggggaggtcgaggctgcagtgagccgtgatcacactactgcactccagcctgggtacagagtgagaccctgtctcaaaagaaaaagcctctggccaccaaacggagaatagaacagcttgggagcctactgcaatagtccaggcagagaaaacagtgattagagtgaatttaagtcaaggtcctgtgtttactgactccgcctttatttttctccctgccccattcttccttctgctgctttccctaggaggccctgccatcacagactctaataatatctataattttaagaaactagccataggaaggcatctcactagttatacatcaaaatcacccaagttgagggccgcagggatttgtctgggaggggtacagggttcccctgctcccagctgaagcaggcctccaacagataggagccacctaagcctcaggaatggcaaaaaaaaaaaaaaaaaaaaaaaaaaaaaatcatgttttgaatcctgaaactccctggcaccttgctaagtccccatagatagtgtttgctctgacttagacctttagaagagcaaattcattcagcatttcctatgacactggcaacgtcgtcatctgtggcaggtcagcaaaatattgattttatcaacgatggacttactggatggtgcatccaaaaatatatatatataactcacaccttaattctctaactcgacgtagttaacttggattgagattaaagggttttttcttaaatcacgttaaatacaaatatcaaacaaatcatagcacagtggtacacaggcccccaaaaagccaccgtgaatggggaggcagttcaggagtgtcatgggagaaactgcattctagcagttgggtggtttgggcccccaagtttaaatcccaacagatgggcctgggggtgaggcctctccagcccatcagagtcacagaggtgtcagagtgacctcaccctcaacccagtatggtgggaaggtttggtcatggaaagaaaccgggtctgtttttgtctgcatgtccccaggtttatgttggacgaaagaagttgaggttggctggcccagctgcattgaaaagcttgaaaactggccttttcatttctgtgtggccgtgtcgttcaggtccttccctcccgtcggagctgtccttctgcattagggctggggctgggcaaggggatgagatcatatgtttttgtgttacagaggtaggtttacacagcctcgtcgctatggcagttttaataaagcaggttactgtccccaaggggaggcttagcacatagcactgcccatgcacagatgctgctgtcattccggggcactgttgtcctttactcgtggattgacacagcgctcctccgccagctgatttgggaagggtgagtgctggccaagagcacctcacagctcgcttcctctggaatgaggaggaaggagatctaagcatttcgagaccctggatctgagcccattaaaaacaagaaatggttctggaggctgttcactgtttgccaaggcagcactgggggctgcggagtgcaggtgatttcatcaggtgacggcctgccctgcgttcccttccaggagaagggtctgaccagttaggtgggtggccagcttttgtcctttctgcagggtctggagaccgagagaggctgagctctcactaccagctgcttcgtcctttctccttcgtgtttgggactagggagcaaaggatcgattccacttggggtgccctggactcgtgcatttaagaaatatttatgagcacccactgcgtgccaggcactgttctaggctgagctgtggagccatcaaaagtcacagggaacagcaaacgggatcagtagataaaaacataaaagtatatcatgtgttagatgatgagtgcagggttgaaaatgtcaggcaaggaagggagtagaaaatattgggggccagggaagactccacggagaagggaacttttgagtaaagacaagaagggggtgagggcaccgctgcggggctccgggggagaggtcttccaggcagaaggaacagcagggcacaggttctgggatgggagcacgcctggtcagtctgtggacagagcaggggaccctgtggctgcagagagtgggcggagagggggatggggttagggaggggaggggattgggtcccaccacactctgtggatggccagaaagatttgggctcctctgagtgagcaggagccccggagagtgtcaggagaggagactctggctacaccgtggggaataagtgactggagtccaatcaggaagcaactggcctgatttcagggagagaggatgatcgcctgacccacgggggaggtggcaagggtacgatcgtgggtgtttacgttgaagagagggcaacaggctttgctgatggattggatgtgggaactgaaagatgggaggaaccgtagccaagatgattgcccaagtacccggaggaaaggggagtggcttcgggaggagcaggagggacggtgacatcagggcttggctgtgggtgtggcacctgaggtctaatcgacagccgaatgacatcaatggatgtcagggttgtaccaagccacacatcaagggatgtcaggtccgggttttaccaagccaatgattgccaaattctaatcattccctcacaattttcatcatatatctgtgtgccacttgtacgattatttactttttaaaaatcggctgcaattgtttgttgttgttgttgttttaagaggatttccaccaccctaaaggaaaagctaaggttacttgccctaagtagaaggaaaccaagccacgcaattaatctaaggcaatgccaccccctgcctggagctcccagtggcctttcacaccaccagcatccctggtgtttggtgatgtgaccctgggccacccccacccctggtgtgcctgatgaagtcaccactagaggacccccttctgggtcaccaagggaccattctgagcttaactgaagccaagagtggaccaagagcatggggacctctatgcacttcctcaggacactgttaccacctcccgtgtgactgtgacattttgtgaacgtgaaactcagcaccccgcctctgctaggcttgagtcttcactgccttcccagctgtgcagccttagccagtcattcagctccccaggttcagttccctcttctgtcaaatgggccattgggagaattaagtgatgaatgtcttcagcccagccataagcattcagccagtgatagtcgccactattaattataatgattattactggcatagaagactgccctcttccccaggaataagttggagtgctctcagttccttagctatatcagaaggttgcaacacccaagccttcaggggtcgggcaggtaatgagagtgggtgcaggtggtgtaagactgtagggagcacgggggagtgtggcaaactggagagcacatatcctgtgtgatgctatttaatgtcacatttttaaaacccactctacaagacaccaacacacaggtctgtggacaccaactggtttggattcctgagatatgaaaacccgagtgtaagatagtattttatatgttaatttagctggtctctgttgagcacattatgtgccaggcactgtgctaggcagtgaacaaagtaggctgagtctctgcccttgtggtgaaggcagcaacatacaaataagtgaaatcaaaatgacttatgtttgaggacagtaactgctgtggagagacacggagcggggaagcagagtggagagtgctatgggttgcgggaggtggtttcaatacaggccagggaaggcctctccaagaaggtggtgtctgatcaataacttgaaggagacagaggtagccctgtgattggaggagtgagagcatcccaggctgggggtacggctgaggcaggggccaggaggtgggagggcggccaatgtgcaatactgggacctcaggggcacgaccttggtgccttgattggtggtaaaaatttaaagtagaagcagctgattgctgagcagagggccttccccagatcccaggaggctgcagtgggtctgatgcttgttttcaggtttctagggggttgctaggtgattgggatcacagccttcacatgcctggtagaccctgttttggtttcccactgctgtcctaacagatcacaaactgggtggcttaaaacaacagaaatttactctctcaacagttctggaggccggaagtccaaaatcaaggtgttagcatggctgtgcttcctcagaaggctctaggggagagcccttccttgcctcttccagccctggggaccctaggagttccttgttccttggcttgtatgtgcatccctccagtctctgcttccctttgaatgtggccttcccctctgtgcctgtgcgtcttctccactttgtgtcctatgtggacacttgtcactggatttagggcccacctggggaatccagaacaaatctcatttcagtagcctcaatttaattacatctgcaaagacaccctgtattggtctgtcttcatgctgctgataaagatatacccgagactgggtaatttagaaagaaaaagaggtttaatggacttagttccatgtggctggggaggcctcaggatcatggcagaaggtgaaaggcacatcttacatggcggtaggcaagagagaatgagaaccaagcaagagggaaaacctttataaaaccatcaaatctcgtgagacttattcactaccaagagaacagtatgggggaaacaacccccatgattcaactgtctcccatcagatccctctcacaacacgtgggaaatatgggagccacaattcaagatgagatttgggtggggacacagccaaaccatatcaccctctttccaaatatggtcacattcacagcttccagaaattaggacatggtcttatctttaggggacgggggcaccgttcaacccactgcacaccttaagaactgcaaggaaaaggggaaaaaccaaggatggccatagaagaaggagagagggtttccatggaatatttccatcaaatcactaagggtctgggtaccaaccacagcatacaattgagcatgcactcgtcacacctatgttgagtacccactgtgtgtcacacacggcagcagtgctgaggattcagcgctgagcggagcacacagcctttgccctcctgggaccttggcctgcacgcagtagggctcccacacacgttcatttgcttccttccttccttcttgcctttcttcctaagtgtcttgctctgcttacagcttggttgagaaacaagagcaggcatggccaggcaaggtggttcatgactgtaatgacagcactttgggaggcagaggcaggcggatcacttgaggtcagaaattccagaccagcctggccaacatggcgaaacgtcatctctactaaaaatacagaaactagctgcgtataggggctacttgggaggctgaggcaggggaatcgcttgaacccgggaagcagagattgcagtgagtcaagatcacaccactgcactccagcctgggcaacagagcaagactctgtctcaaaaaaaaaaaaaaaaaaaaaaaaacaaagaaaagaaagaaacaagagcaggcatgaccgaaacctcgaagcctggggtatgatcagtactcaggacacatgctgcaagactgctcagagctctcaagcccagggtggtgccagaggctccctacgagagggtactaggccgatgggttggatttggggtgaggggtggtgggttccaggctcgaagaaaagtgtggacaagaggccagcagggtttgtggctgatggcagagcacctcagccagggaatactcagggagaaggtttgccaccaggttggcatgaccagatttcagtaagagcaaacaattattgggaaagttccaaagaaaagaaagtataatcttccctcaatttacatggtggttggtttccaaaagaaaaaacaaaacaatgtatattaataccctgcaaaaacaatgttgtgtttaaaatttgtaaaacagtttgattccagtctcaggtcatttataaacaggtttttacctgccttgcaggtagagatgcaattacagtaccggacagtgacagtacagtcacttacagtcactcacctccagcaccattgcaaaatcctccagactccagacctggacctcaggagtgtccaggtggactcgggacccagggtccttcctgattatgcaggacagtcccaccgtgcagcagtggcccctgccccgtctgccccgtaggtctgcagaatgtgcccactccagacctagggatgccacgtgctgagagccccctggtgccggtgccgcccgggtctcctgccctgcgccttacttccacccttgacttgcaggttccatgcaggtgatgaacaagacccggcgcatcatggagcagggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacaggtgagcagggacgggggcaggtgcaggaagggagtgacagccagggcgggcgtccctaggtgtggtctgcacaccactgcggtacccaagttgattctggatagcccctagagcaactctcttataatttcagagttgtgcatttatttctgtgtgtattaaagaaatacagatttatttgcctacagtagtgatgtaaagtgaccttgtcaaaggaatttgagtcccccaaaaaagtgagtcttttcaaactatgaatcatagtgtggagaggccataaggtgcccatgcatgagtttgcatcctctgttaatagttattaagcccatcagggactgtttcgttgacttcaaaccattagcttggaagaaggttccaaaacataggggtgggggatgggaattcatggaggggaacagataatggggctgtgtggtcgctttctacgtggcagtaaccaaggtggtgcagaaactgacatggtggttgactgtccacactcacccgtgtcatcctgggtggagggcgacccagttcctgtttgcttatccttcaggaggtctttggtgggctctgaaggctcacctgccaggctggttgtctgaggtagagatgcaattacagtatagtcacttacctgtagcgccattgcaaaaccctccagactcaattcatttaacttgctttaattaaaaataaataaatactccccgccttgggtaagaagccgcggcggttgtgaaatcaagatattgtggctcagatgttgcaaccccaggaagttgcatccaagtgacaaggggtttgtttgggtgggagtgccgcaagggaaggatggactcctcctccagccctgtccgcagtgctggacctgcagccctcgaggctgggcagcttcctctcagatacacagtgtgggctggcagggatgctttggtgtggggagcaagccagtaaggtgtgtcttcttacagcctcatcccatagccagaatcacctagaaagtatgttctgctgagaactaggaaggcctcgttcctataccttgttcctgtgtattgtgcgtgccattatgcagaatcaaccacctgttggttcccctgagcctctgcagaaagccacatgtgtcagaagttaccatggccaccaccctagatgattggcgggggcctggatgttgctagcagaagcaggacaggcaggcccgcagcacagcagtgggcccttattgaagatgcacctgcaacttggctctagaaagtacagccatgcactcaagagtgaccagccttgaaatgttttaaagtctgaatatttcactgaaaatcttattttaaaatatgccggcacagcttattttttctttaatgtatactgggggccaaagaaaatatgtctgaggagtgagtgtgtggctcacagactctcttttcacaacctctgggtgaaaggtctgtacagaaacctttcgttttggatgctggaagatcagtaaagaccctagacctgttctcatcaatccccctcatttcacagccagggccactgcagcccaaaaaagagacctgcccagagtcaaagtgaggtgtttgtggcataatcaaaatggaatgcaagatcatgggaattcagagggggcatggaaatagtattcatcagactgaaaggaaactcatatattctgtgccattttgagggctcagggtgggagctaaaggctagtgtttcaaaatcttacaggcgacatgagaaaatcaatcatttcaagaataaacattctctaaagtggatttcccaaacttgtccttgaatgtatgcaaatcaccaaaaagctgtctccctaaataagtgcttttattcaactatgattcattattataccctcatgaagactgggagcgtaatgtcaagtgtaaagagccagataccgagaacatttacgtttttgtaaaactgccactgagaattttattcattatatttagaatgccactctgtacaaagaatcccattccagccttactttcagaactcaggaccctgaaaacacctgtttagtctgatgaactggtgtactccttgttattacataataagagccacataccctgtatagtttccctctttgccctggcagctaggaagctcaggtttgagttttatattgagttgttgtttaaagtggaaatgtttttaaagatccaactgcgtgatatgttatactgatcagtgttgactaagaaaaatgacaaaaatctataatgaattcaaaaccttttagattattttttccttttagattgatttgtacatacatattagaatatactgtaaatttttaatcccccaaggaccaaaagtaaattgttcctgctgagtcttcagccatgttaaaccctgtgttcacgtggccacctagcaaagttggttcagttggatttaagtttggctgtgtgtgtgagagagaccggggatgtcaaataaaattccaagttgttctggtggccctgctctatgaagtggtcagagactccgactccatttctccttatttcccattggtgagaaacaagtcatatggccatgcatggcagcaaaggggcctgggaaatgtagtcttattctaggtggacatttgcccagatgaaagttattttactgtgggagaagaagaaaacggatactgaaggacaagtgaagtctaggccaccctaacagttattagccatttgtgtttgtgatactcgtttgaatagaggagatcagcccaaactgaggaagactgaccccagaaaaatgctacttaagtggaccaacatttcataataaatagtgcttttaatgtatttagtaaggtatttgatcttgaaatgaaactacaatgtttcgagaataactctgttatgttacatctctttttttctttttctgagacagagtcttgctctgtcacccagactggagtgcagtggcacagtctcagctcactacaacctctgcctcctgggttcaagcgattctcctgtctcagcctcctgaatagctgagattacagacgcctgccactacgcctgactaatttttgtattttttgtagagatggggttttgccatgttggccaagctggtctcaaactcctggcctcaagtgatccacctgccttggccttccaaagtgctgggattacatgcatgagccaacgcacccggccctctgttaggttgcatctaatgatatttaacaaatattgggctctagttgcaactaatgagttgattcttcaagcaagtgaattgacgaagtgtagggaggaatataatgtgtttcacaaattgaaatggatggcacaagatgatatcctttacttcactagggacatttttgcaaaagtatttgaggatttgatcaattttttcaagggcctctcctaattctctgacatctgaatcttcccctgtgaagtgcatctcatacttcatcatccttctcaatagtctcttctccttcatgtagtatctttatagaccaggtaattattcgtcagtggatttgcatgtgttttttgagctatcttccagcgtcattttaattaattttacaaaccctgcatcttttaaaatatttgcaatttcattttgcagtgatcttgctttgcatggccccatgtttgcagtggagattgacaaaagacaaaatgagagaagctaagtttaagcaggataaatatcaatttgttcatgaatatttctctgtatggcttcttacaacttgagggacttggatctcagatatgaatacccttggaaggatcaattgcatcctcaggttttttgttttctttgtttttttgtttgtttttgagacagggtctcactctgttgcccacgctggagtgcagtggcgtaatctcagctcactgcaacctccacctcccgggttcaagcgattctcctgcctcagcctccccactaactaggattacaggtgcgtgccaccacgcccagctaattttttgtatttttaatagagacggggtttcaccatgttggccaggctgacctcgaactcctgacctcaagcgatccaccctcctcggcctcccaaagggctaggattacaggtgtgagccactgcacctcgccacatcctcagtttttacaaaggttttatagtcatcctttaacacagttcagcagttgaagtgctgttgccctgcctgtgatcacttatatatccacaagtcaaagttgtacagtgttcccagaatgagacacctcccagctctctgcagagtggttgagggcattagctttgcctgggtttgaatccagtctctgctgctttctgcctgcatgaacttggacaagttatttagcttctgtgtcttggcctcctcaaccacagttaataatgtcacttaactcatagagttttgtgaagattaaatacattagaacagtgtctggtacatggtcgtggtaggcacttgggaaatttagcaatgatggctgggtgcagtggctcacacctgtaattccaacattttggggggccaaagtggaaggatcacctgaggccaggggttcgagaccagcttgggcaaaatagtgagatcccttctcaatttttaaaaaacagtaataaaaaaaagttagcaatgacgatgacgatttgcacaatagcacaacatcacacagcccacctcaggccagtgttctgatgaatgtcatggtaagttgcactcatggatcaaaatgtggcagcatgtgctcagcctctggtaatcagcaaaatgcaaacgcagccaacagtgcattatcacatcccagccatgaccacagcaaatatgaagaggtcccatcgcaccaaatgttggtgagaatgtaggaaaacaggaaatcatatgcgccagcagcatgatggtaaattgttccctccactttgaagaacagtttgccaatttctggcaaagctgaaaatggacatctccttctactcagcaattttactctggctgtgtccccctcggttctgaggaggtgatgttgatgtgtgagttctgcttgagcaagggaacacacttcctggctgccctgtttgctcttgaagatgtgtgatgctcatggcaatagattccctttagatccaacggacaggaaccccgactgcagctggcttcaaaaacattgaattttttgctccctaaacaggccaggcacggtgactgaagcctgtgatcccagcactttgggaggcagggatgggcggatcacctgaggtcaggagttcaagaccagcctgaccaacatggtgaaaccccgtctctactaaaaatacaaaaattagccaggcatggtgatgtacacctgtaatcccagctacaggggaggctgagacaggagaattgcttgaacctgggaggcggaggttgcagtgagccgagatcgcaccactgcactctagcctgggtgacagagtaagactctgtctcaaaaaaaaaaaaaaaaaaaaaaagagaagatacaggtgagtagcaggcagagtcggatcttgtggtttacgagtatcatgatcatatcacgaggctggaggtctggacatggtggctggcactccagcagctgtgtgcctccttgtccacatctggcaggagcaagagagcatccttttccagaatgctcaaggcatgagatcccttctgattggaccaccctgagtcacatgccagcccctgagccaatcatcatataaagcacatggtttgtgccaacttgcccagcgtggatcacctgctctgcagcagctggctgagtccctttttccccagcacttggactgccaggtagaaatcaagggctgctggaaagaataaggaaaagcatactggagtgccgatcacaattttactacactgcctttggcaaacaaaaaacaaaaaaaaagtaacatcagctggccgggcacagtggctcacgcctgtaatcccagcactctgggaagccgaggagggtggatcacaaggtcaggagtttgagactagcctggccaacatagtgaaacccgtctctactaaaaatacaaaaattagctgagtgtggtggtgggcgcctgtaatcccagctactagggaggctgaggtatgagaatcacttgaacccaggaggcggaggttgcagtgagccgagattgcaccactgcactccagcctggtgacagaatgagactccatctcaaaaaaaaagtaacaacaacaaaaaggcaaccttttccagctctttctggtgaactagattggagtgccattttctccccattgggataatgcctttctccttccacacctgaatctggcagttctgaagttgtttcccagccccagcttctgccatccggtccagactttcgcagagatggtggcgggccctctgcccttctgcatcatgttctaaaatgcgtcaggggagcagggggtacatgctccttacaagaccaggccttgccagggctctcagttggagcctgttttggggtttggccctgagcgccccagttattttcactcttctcgcacaaagctgggtagagaggtcagctgaggaccagaacctggccatcagccttgggcagctaccctcaccagggtctggggggcctctgtgtcctgatgaccccaccccatctacactacactacacttggggcaccccatcgccctctcacacaggaggatggaaaggcgcccgctaggcattttggcatccccaacaaatgagacttgttttttccctaaagcggtttcattcaggaccgcaggggcaggagggctgctgcgtgggccgtcctcctctgcaatgctataaagtggcccaatgcccctctttccctgccactctctggatctacccttagccccttgccctgaaccccatccaccctggcccctctgcctcctggccatcgccccagagctctccccagcacatcaagcatgagtccagcatcacttcctggtcccccgcctccccggcgcctctcacaggcttctcctcggcacctccagttttccagttgctcaggccaaaaccttagcaccattcttgattttttttttcctattcctttcacactccacattcagttcatcagcaaaccctgtcagctctgccttcaaaatatgcccagagtcccctctgctgccaccagcccatccgcgccactgtcttccccgcctgccctgttccaggtttctcctgggatcccccagcttctgcgtttatgaccccttggtctgttttcaatgcagcagccagaggggtctggtcagaacctagttcagatgctctttctcctctgggcagagccctccttggctcccacctactcagggtagaggccccgacagccacctcagggtcccagtgatccttcccttctctctgaaccctctcagcctcctggtctcccctcagtcactgtcctccagccacagcttctcaagcagtcagccacacctgacatgcacccactcacagtgctttgcacttctttccttttctcaaaacttctacacgtctgcactttcctcgtgtctgtgttccaatgctgcctcctcaaagaagccttccttgactaccccatgcctcctgttcatcccagttttttcccaccagtgcccccatcaccactgaacaccactgactgtgtattctgcccatttgtctcattgattgtctcgtttctaaaatgccagctctcaggctgggcgtggtggctcacgccagtaattctaacactttgggaggctgaggcgggtggatcacttgaggtcaggagtttgagactagcctagccaacatggtgaaaccccatctctactaaaaatacaaaaattagctggatgtggtggcgcaagcctgtaatctcagctactcgggaggctgaggcaggagaaccactggaaccagggaggtggaggttgcagtgagccgagatcacaccactacactctgtcgcttgggtgacagaatgagactctatctcaaaaataaataaataaaatgccagctccctggaagcagcggcctctgttctgtgccctcgcgggttgccaggcctagagagtgcccaccccatcgtaggtgctcaggagaccttcccaggatgactggtgactaagtctccacattctgtccccgccagcagcccacccccatctcttccacactcctttctcctctcccgtttctctcctctccacccccactcccaccatctcagcctttcctcctctttcttctcagcctctctgcacacacagggaagagaagactgaaattattcccgggatgccgtccctgggcccctggtgcagctgtccctgccttcacaatggcagccttctctttgcttggctcttctcctgggtttgctccctgctctcttcctctctccttgagtgcacacaagtgtgcacgcacgcacgcacacacacagctcccttcttccctcggtccagctgcctctcatctgcccatcttccctccccctctccggcctgtggggggacagcagagcctctccattcaccccgtggagtgtatccactgctcacagcaggtagccttcctgtctctctgcagcgaacacccagccttccccactgtggggatccgagtatccacgggaattgcacagcccctcctgggacccaggctgacccagcgtgtcctcgagaggcacggatttgccgcctccgtgcacatcttcaagcgaaatttcttcctctaatttgatagtcacttcctttctctaagacctcagatttcaaaataagtgaagcacttgttttgagcaagagtctaaagaattagactccgccttaagcgcccttgtgaccttgagctgagacctcatcccctctgggcgtcagtctctccatctgtgcagcagtgttgtgacatctaagcactagtcacccagtgcctgtgataagacgccaccctgagtgatacgtgacctgtgcccacaaacccaggaggagaggttccctgcgccgtaagaggaagtggccacggggaaagaggaagctgatgtgaggccgatggggcagggtttccgattgtttccaggcgacaccctctctgtcccacccccttagcaggtgtatccacttccctagtggaccacagactgggtggcttagaacaaaaggcgattttcacagttccgggagccagaaccccaaaatcaagcatcatcagggccacgctttccctgcaggcttcaggggagggtcctttgcccttgagttcctgggggttgctgggaatcttggcaccccttggcttgtggccacatcactccagcctctgccttcatcttcatgcggcctcctccctgtgggtccctctcttcccgtggcctgctcctctctgaatcagtgtccaaatttccctcttctgtcaggacaccagtgattggactagagcccgctctgatccagcgtaacttcatcttacaacaccatgttacaaacacggtcaccctcacaggtacctgggcaaggacttgagcatatattttggggaacacattcatctcgtgacggctggtttctttcacacattaaaccccgcccccccccataaaggctgcagagccgatgtcaaactgagcaaacctgccgctcttcccctcttcactgccccagctgtggtcctgggtggggagcagtgtggccgccctgaagatcagctccatgcgtagccttcccttcccaaccatggtttctctcaaggaatctccacctgcagtgggcgttgaaacagctgcagggtcaaaagtgagggaagggtgactgtggtgacagacaggcacaccctgtctcctgggcctcaagaggcttccgggggtttcagagtgcatgagaccttttgtagtcctctcctaggtgctagctgtgactccctgaacattctggaatgagttaggctggagccaaatggcccagtaccgttgccactagccacagggagctatttaactttacgttaattacaattagcatttcagtttctcaggtgcactagccatggttcaggtattcagtaggcgcacatgggttctgtactggataatgcacatagagaatgtttccattggcacagaaaggactcttggacagcaggagaatagagcctatggctgggcctgtaatcccggcacttggaaaggtcgaggcaggaggatctcttgaggccaggagtttgagaccagcctgggcaacatagtaagacctgtatctttacaaaaaatttgaaaaaaaaaaaattagctggacatggtagtccatgcttgtagtcccagctacttgggaggctgaggcaggaggatcacttgagcctaggagtttgaggctgcagtaagccatgatcacaccactgtacttcggcctgggcaacagagtgagaccttgtctctaaaaaagaaagaagaataaagcctaatcaaacaaaatcttttgggagtggggagtgacacacagcactgagaaggggcaataaaaacgcagggggtggtggctgtcgaactttaggtgagtgctttccgtgattcctcatctgtaatccaatctcctcctcctcatccctgcactcacttccccttatgctcccagtaccttgatctgtcttcccaaaccttcctgggtctcgggtcagggtctcaggacaggttcctgttctccgagcagcagacaccatccatcccggggccagcaggttgtgccagcccacacagcgagtcctttgggaatccatccgtgtcgcaggggatttgagcaaatgaagggaaaccgagttcctacaccgaggccgggagcggggcttcctctgtcatccctgtgtgaacccgttctagcctgggggctccaaatgcatagagggctggcaggtagcccaaagcagagaggcaggctgggtggggagggggtgcccagatttcaactgtggactgttcactctactttttaagaatgagcaactgaaaacaccgggcaggcccacagcaaacacacctgagggatggattggtctgcaggccaccggcttgcaaacttctttctaagctggtggttctcaagggagcacaccgccccctaggggttaaactctgtgactgcattgccggtgatggtgaaggatttgactttgctggcttyctgggggcggagactaagaaggaytytgatgtcytgctctgcacagcagagtccacgtggcccccacattgcattgtattccacatagcttctgagtttcctaccacatcactcatatgggtagattattttatgtttattgtcatctgagtcttgaacctacgtctattttatatgtaaatactggagggtttttgcatattcccaggaatgtacggaataagaaaatggaggcaatattatacttgagtgcaaaactttcccaagagtcattccttatttctgaaagtcccatccccgatgacagtgctacgccaaaggatttgaatggcaaatgtcgcccgcccacccagctgcccttgtaattgtcacattcccagtgaatctgtgtctaggtgcaggcgtctgcctgactactgtgttgtgccttcttgatggatgtgctgggggaatttcatattgaaatttatcttcattataaattgctttccttttattttccctgtagattgcagttagagcattatattgattttgtggaaatgacatgcataggtagcttttgttacctataaatttcctttcaagaaaacaagggcgctctacaaaatatttgtcatagaaatgggaggtcagtctgatggcgctgagaacagctctttgaaaggtgcaagtagtgtcagattcctccaaggcgataattaaatatccattgagtgacaggccttgttctgagggtctgttgtggattttctccccctcctctagtccatccctctgaacaaaaccacactttaaaaggcacaagacagatatttaagacacagcttgtcctcgtggtgactcagcaggcaataaaacctgtcactagagatggagccctccatacccagctaattgagtttccagggaatgaatgggcctcatcctcatttgcaggagctgcaagacccttctagggagcggatggctggagccagcatttaattaggcacaggcagcccgccctccatgccaccaacacccagagctccgcctggccctgctacaaccagtcagcagggccttggtgtcccccgcagcccagtcttcctcaatagccacagcctcactaaaaacaggcaggcggaagacaggaatgcatggagtggcaagacagaagcagctctcgcctctcgccctggcgatctgcttgtccctgtttgtccccagcaactggccattccttctccccacccacagccggaggacacttttaaaaattgtaaacctgaccacatcacttccggctgaaaacctcctacggctgcccactgctttttggataaactggcatctcctcgccagggctgccaagaccttgtttggcctgggtgtgctcacctctctgtccacatctcctatctgtcccttccttggtgacagcactcaggctgcctagcctctttgttcctcagaacttccaaggtccattcctgccccaggccctttgtatgtgcagttacctctgtctggagcactggcccacaaccattctggtacaagcaaccggtttcgtggaagacagtttttccacggactgggggtgagggatgttttgggatgattcaagcgcatttcatttagtgtgcactttatttctaatattatcacattataatatgtaatgaaataattatacatctcactataatgtagaatcagtgggagcccgagcttgttttcctgcaaccagatggtctcacccgggggcaatgggagacagtgacagatcatcaggcattagattgtcataaggagtgcacaacctagatcccccgcatgcacagttcacaacggggttcacgctcctatgataatctgctgctgatctgataggaggcagagctcaggcagtgatgcaagtgatgggaagcggctgtaaatacagatgaagtttgctcactcgcctgccactcacctcctgctatgcagcccagttcctaacaggccacagaccgctacctgtctacctgtctgcagcccaggggttggggatccctggtctagagcgttgttcacacactgcggagaacttcctccatccattctctcttccttcctgcccttcctgtgtcggttagtactcctcaaccctctcattctcgaccatgacacccggctttatgttcttcttaggacttctcgcccccttgaaattatcttgcatgtttgtgaacttttttttttttcttttttttgagatggactgtcactctgccacccaggctggagtacagtggcatgatcttgactcactgcaacctccaactcccaggttcaagcaattcccctgcctctgcttcccaagtagctggaactacaggcacccaccactacactcagctaattttcgttttttgttttggtttttttttgagacggagtcttgctctgtcgcccagcctggagtgctgtgccacgatcttggttcactgcagcctccacctcccaggttcaagcgattctcctgcctcagcctcccaagtagctggcattacagttgcatgccaccacaaccggctaattttttacatttttggtagagatggggtttcaccatgttggccaggctggtcttgaactcctgacctcaagtgatccacctgcctcagcctcccaaagtgctgggattacaggcatgagccaccgcacccagccaatttttgtactttagtagagacagggtttcaccatattggccaggctggtctcgaactcctgacctcaagtgatctgcctgcctcggcctcccaaagtgctgggattacaggcgtgagccactgcacctggcgagtgaacttgttttttacatgttttgtttgctgcccatccaaaaatagcaccaggcaggtattgggtactcagtaaagatttgaacaaggccaggcacggtggctcacacgtgtaatcccagcacttcgggaggctgtggtgggaggatcacttgagccaggagttcaaaaccagcctgggcaacatagagagaccctgtctctacaaataattttaaaaactggccaggcatagtggcacacacctgtggtcccagctctttgagaggctaagatgggaggatcacttaagcccaggcctttaaggccgcagggagccatgatcgtgccactgcattacaacctgggcaagtgaaacctcaactcaaacgaataaaaaaaatgaacagatggagaactcttgggccttaggcttgaagtcagcaaaaaaataaaaacaaaatggaatttagattactatctcatttatccagcatgaagaaacataatcgaaattagttcaggcaaactttgccaggtcccagtgctcaaacgctgtcagaaccctgtctttctgcttcttgcgttttctgtcattgggttggctttattaggaaggttccctctttgtgatggcaagatggcccccacaggtccatctccccagtgtggtgaccccagctgaaagagaggcctctttccaagggctccagcaaaagttccagggaaagctctcattggctcatctagggtcttatgtctctttcacccaatcacagcagccaggcaaaaggagataccctgattgtccaggccaacctcatgggcctggtccaggattcagagctagaaagagcctcatcagaacatgtaaggctgagaaaggggaaagattggttccctccctctttggtgactgaaggcacaattatgaaaagacaggagaatggattctgggcagaaaaataaaacagatatccactatagaaacccacatgcaggccgggcgcagtagctcacgcctgtaatcccagcactttgggaggctgaggcgggtggatcagttgaggtcaggagttcgagaccagcctgaccaacgtggtgaaaccccgtctctactaaaaaaatacaaaattagccaggcgtggtagcgcatgcctgtagtcccaggtactggggaggttgaggtaggagaatctcttgaacccgggaggcagaggttgcagtgagccaagataatgccactgcactgcagtctgggtaacgagtgaaattctgtctcataaaaaaaaaaaaaaatagcttcttcttaaagggcaagtgggaggagagcatttctcccagcccccagctcgctctgcttccaacataagatgcctctttcgtgcggaatcatgaccccaccttcctcatttgttttcacacagctttcagttcagcaagatcccatctctggcatccagaacttttatagcattgatttatcacttcgtgcagtgatttgcatttggtattttttttttcaaaagcagaagaactcgactcaggctgtaaccttgcaaagcagcacaaagttaaaaggatccagttacagaatatcagaaataccccagccctgagagctgtggagctctgggtttatttaatgcatttcttgccagccctgcctcctcagccaatttgtctgccaaaaaaacaaagacttcagtcctgtggcatttcacatctaatatttatgctgttctagagtttgcaaaagggcttccttttcatttatcactgttcctcaggaacctccagctcccctgctaggttaatgggattgttctctgctgcccagaccgggagccccaggaagccaaatgacagatcatgaaagtggcccagtggaggactcttctactggtgtcaggggtaggatcaaaactcagcctgaaccagctcagtttctattttgtgaccctgggggccaaatatggatcttgcaaaatggcagctggcagcctgagtctacacttcaaccccaaatttctgtcagagttacaagatgctttttaaaatctggaaatttaaccaaaaatacccagattacaaacttctctttaaaaaaaaaaaaaaaaagattatgataggcctgtaatcccagcactttgggaggccaaggtgggtggatcacttgaggccaggagttcaagaccagcctggccaacatggtgaaaccctgtctctactaaaaatacaaaagaattagccgggcgtggtggtgtgcacctgtactcccaactactcaggaggctaaggtgggagaatcacttgaaccaggaggcagtggttgcagtgagccaagatcatgtcactgcactccagcctgggtggcaaagtgagaccctgtctcaaaaaaaataaaataaaataaaggccaggtgcagtggctcaagcctgtaattccagcactttcagaggccaaagcaggtgaatcatgaggtcaggagatcgagaccatcctggctaacaccgtgaaaccccgtctctaataaaaaatacaagaacaaaattagccggtcgtggtggcaggtgcctgcagtccgagctactcgggaggctgaggtgggagaatggcgtgaacctgggaggtggagcttgcagtgagtgcagtggcactccatcctgggcaacagagcaagactctgtctcaaaaaataaaacaaaaatttgaaaaagataataatgataatgatggtattgccattactggtaacattcctgcatggtggagattagtaaactgtggcctacaggagtctgctgccaggttttacaaagttttctggaacacagccacacccattagtgtatgtactgtctgtagctgctttggctctacggtggcagaattgaatcattgcaatagagaccttatggctgcatagctgaaaacacatagtctggccctttgcagaaatagtttgctgagccctcctaagtggcgccagcccactggatttgtgccacagatacccccaggatttattagaatataggtggagttgagggtacttcagtccctaattaacagcggattagagatgataggtgcttatttctctcccatttgacagtttgggcataaacagcctagagatgatgtggcaggcatggtgttggctcccaggctcctgatgggtgatggtcagatggcgttccatcatcctgggcgatcgtccttatctaaagcagcatcccatcctgtctgcatccaaccagcaggacacagaaactataagggaagctcacttcccttcctggaggggagtttccagaagtcacacaccacctggtgtacccctccagttcatagaaaatacagagaattacaaaggaagccagttatatgaaaacatatttatcaaaatattttataaactgtgatatgtatgcttctttacacataaaatggcacgatgaagcagttatttaatggacaatggataggtctgataacttccatgatttcgaagtagcgctggctcaaatgatattttaagaagtccatgttgactacaatgtgatatgaaaatatccgtaattcccattggtgacaaagtcccagggaccatcattcataattgaaggggatgctagttataggttaatgaaaataaacaaatacatacttttgccattcaatttcaggaaattatatcttgggacaacagattaagaacctcttcctcaggtgatctgattcgattccatggcattaagtgccatctaaatgcttacagctcctcagtttgtaattccgtagcttttctgtgaacctggtctgtttccacctgaatgtctaacctgagtctcgaggttaatgtgtctgatttctttatcaacccccatccccaactctgcccctcccagtgtccctttcctaaataagggcaaatctgtcctcctcattgcttggaccaaaaaccttgagttatccttgactctctttacttctttcgcatgccacatcagcaaatcccattggttccacctttaaaaatagcctggaaccaaccacccaagcccttcgcctgccacgattgtggtcatcacagtctgtctcctgaatgactgtgagagtctccaaacattccagttccctgcctcggactggccttaattctaggacagaagctccaggaagatgcaggttttttgctgctttaattttttctgttttgttcactggtatccccagtgcctagagccatcccagccacacaggagtcctcctttaatgtttactgattgaatgaatgaatatataacatcatgatcaataatattatgataaaaacagtaaccatttagaggcagttaacatattttctcattgaatctttcccagcaactttgtcatgtagggatattattattattcctattttgcagttgagaaaactgagctggaaggcagaggtagctgaacttaaatgcaagctgttggctccagagcccatgcccagccctcagacctgcctgcctcggaggataaaaatcatttctgaggccaggccaggtggctcacgcctgtaatcctagcactttgggaggccgaggcaggtggatcacgaggtcaggagatcaagaccatcctaaccaacaaggtgaaatcccatctctactaaaaatacaaaaaattagctgggcatggtggtggcgcatgcctgtaatcccagctactcgggaggctgaggcaggagaatcgcttgaacctggcaggcggaggtttgcagtgagccgagatcgcagcactgaactccagcctgggtgacagagcgagactccatctcaaaaaaaaaaaaaaaaaattatctctgaaaccctacacttctggaaagactgatctggataacgactatggctcctacctgtgtcccccacctatgcttcaagaaaggcaaagtgcccgggtcctgggaatgaccttccttcaaaagcccacggccggatgaattctgggaggatgcagcatgggaagataacctcagtgtggaaattccctttgcctggaattctggcagaaagcacttcggagatagtctgagccacatcggagaggaggagctctcggaggctgagtcccatttgtgtgtgtccccacctttagccatggggcagtccctctgctgttccctcttccctgcctctctgcgtccccgtggatgggaagagctccagtctgtggtcgctggagtcctgctgagaggctgaacagggtagtcaccaaaaggcaggtggagacagacaacctgggattgagcctcatttcagctctgacacttggcagttgtgggatgttcggtgaaaaggggactttgcctctctgtgcctcagtttctccatctgtaaaatagggaccaaaaaaaggatctacctcactgggatgttgtaggtcatcgtctaaaccagtggctctcaaagcgtggtcccaggatctctagactcaaaactattttcatgataataccaggacactgtttacctttttaccgtcattttccttctggtagacagtggagttttctagcaggtacatagcatatctagttatctaaaaaggattaaaatactcttcccttttccatctgcatacccattttattttattttttagaaatagggtctcgcttgtcacccaggctgaagtgcagtggcacaatcacagctcattgcagcctcgaactcctgggtccaagtgatcctgccacctcagcctctcgagtagctgggaatacaggcacacaccaccacgactggctatatttatatatatttattttttagtttttgtagagatgaggtctcactttgtcacgcaggctggtctcaaactttttgcttcaagcaatcctcctgccttggcctcccgaagtgctgggattacagacgtgagccactgtccctggcctgcatgtctgtgtgaggctggatttttcatgttaaacaaccaaaacaatatatctcagcagattgaatgccaaaacagatttaagaatcctgctgccttccagtaaacaagacattgaagagattggcaaaaatgtaaaacaatgcaactcttctcattaattgtattttgtttgggaaaaatatagttatttatctttttttctccccaagacagagtcttgctctgtcactcaggctggagtgcagtggtgcaatctcagcttactgcaacctccacctcctgggttcaagcagttctcctgcctcagcctcccaagtagctgggattacaggcgcccgccaccacacccggctaatttttgtatttttagtagagacagggtttcaccacattggccaggctggtcctgaactcctgaccacataagtcatcacgcccagcctctatttatcattttttaaatgtatgctaacaagtagtgagtttattatttaaatgagtgaacaaatatgttttaaatttctcagttttcatctctaatataataactatcactagatataaccaacatacacaggactctgggttccttaataaattttgaccatattgaaaagcactgctgttgccttacactgaccttgagtgcttttttggttttataaagcacatccacaaatggaagtcatgtcccgtgtgggccaaatagatccaagttcagccagccaaacaccatacaagcaaataggaagacaagaatttaacaattctacccactcctccactcacagagggtgtgcaccggatgataaaaaaacaaatctacgttctcagccaggcgcagtggctcacgcctgtaatcccagcactttgggaggccaaggcgggtggatcacttgaggtcagctcaagaccagcctggccaacatggtgaaaccctgtctctactaacaatacaaaaattagccaggcatggtggcgaacacctgtaatcccagccagtcgggaggctgaggcaagagaatcactggaacccgggaggcagaggttgcagtgagccgagatcgtgccattgcgccccagcctgggtgacagtgtgggactccatctcaaaaaaaaaaaaaaaaatcgacattccctcactcagctgtgtctcccacaggcctcccattacgaggtgttcgttggttcagttgtttacccatttattccacaaacgttcatcgaggtctcgtcactgaccaagctctgttctagatgtgaggacacaggggacaagggactcagaaagccgctgccctcatggggctggtactctggtgggagaagcacgtgataaaaactagaagacagataaatatgaccagtgaataaatatgtggagaagcaatgtcgggggaaaggggagagcctgggcggtgtggggagatgccatttgaataggagggttaggattgagccccagtaagttaacatttgaggctggacatggtgactcacacctgtaatcccagaactgagagaggccaaggtgggcagatcgcttgagcccaggcattgagaccagcctgggcaacataatgaaaccctgtctctacaaaaaaaaaaaaaaaaaaatacaaaagttatctgggcatggtggcttgtgcctgtggtcccagctacttggaaggctgaggtgggaggatagcttgagcctggggaggttgagggtacagtgagccacgaccgcaccactgcactccagcctgggtgacagagtgcgaccctgtattggaaaaaaattaaaagctttgagcaaatagctgggaaaggtgaggaagcagcccatgcaggtatctgaggaaggtgatttctttcaggtaacagcaagggcaaaggccctggggcaggtatgagctttggggttggggtgctggtaggatagagggagaccccaggacaggaggctggggggaaagtgggggcagatgcagtcacggagcaggacaggagacagttataggactttgtagggcatggcaaggactttggattttagttgaggtggatgtggagccactgaagggctttgcacagagtggggggcttgawmaaawwtgtgatttaatgggatccttctggctgctgtggaagatgggctgaaggtggaggcaggaggaccagggacgaggttccagcaaggtccaggcagaggcagtggtggcttggaccaagatggtgacaggcggatgatgggaagtggtcagacctggatgtgtcctgagggtgaagctgctgggacatatgtgagggaggacagaggagctgaagtcccctccatggtgcgtagccttgacccactggcattgacggatgtatggatcacagggcgaaaatcaagaggccggtgtgaagtgctgatttgacaccaaatgaagtgatttgaaggaaattactaagtatgcagcggtccaaatgatacataaaaacggccaaacgtgtgtgagaggcacgcggacaactggaattgagatgatgccacgaagggcaaagaccccgttttgttttcgcagactccgtgcctgcgaaatggcgcgggtctgttttgggaaggacggactttccacaggcttctgcttcatctttcgccgacctctctgaattgctttggcaaacactgtttattgtcattggctcggctccgcgctccagcccatctctgctgatagatgtgtgtcatgctcagccgacttcactgtgcggcatgaacactcctccccaagctcattactggagtctcggaggggccttgccattttccaaaacggtgtcacatctggtttctaacaaccatttttatttctccagaggtccaagttttcatccccctccctgaaaacggaaagcagactgtattttgggaactcacagttcttttttgtttctgtttttttgttttttattattttttttttttcagagacagaatctcactccgttgcccaggctggagtgcagtggcacaatcatggctcactgcagacctaaactcctgggctcaagtgatcctcctactttggcctcccaaagtgcttggattacaggcatgagccaccacgcctggccctttttcagagttctttatgcacaatctcatttgttgctgcccccatttttatagaagaattcactgaggctcagacaggagcactcgcttgcccaaggagtcagagtcctctgactctgcaaaccaagctctttaaagccacactgcaaccctgtcgttaatggtacatttggacaactttttaaactgtgcactttacacagagtttcacaacctcggcactggtgacactttggggctggatcattctttacggggggaggagggccatcccatgcactggaagatggtcagcagcatccctggcctctgcccgatagatgcctgtagcacattcccccaccccgccaggtcatagcagtgaaaaatgtctccacacactgcccagtgtcccctgcagggcaaaatcacccctggttcagtgtattctgcacacagatgtgcttcaggttggcagccctgcctgctccgttgacccatttttttcagcatgtagcactgtgctgcagacactataatagaaatcccttcctttctttttctccccccacccctgccccccagacagggtctggctctgttacccaggctggagtgcagtggcaggatcttggtccactgcagcctccgcctccacttcctgggctcaagcgattctcccaccccagcctcccaagtagctggaacgacaggcgtgcagcaccacacctggctaattttttggttttttggtagagacagggcttctccgtgttgcccaggctggcctcaaactcctgagctcaagcaatctgcccatcttggcctcccaaagtgctgggattacaggcgtgagccaccacaccaggcctagaatccctttcagtaagacatgcagttgccacctctcctgcactcctgggcgaggggtgtgacgcttaacattagagggcgctgccccaccttgcacagctgtgtacctcaatcaggtgcacctacccagccctcctgtcggccactgctcaccgtgtgcacactctgggccaggtactgcgctggggctacagtgcagcacggctcctgccttacggaccccacaccctagttggggaaatgaggataaacaagaaaacaaatgcatctataggataatttcagagagtgcagagtgctgtagaggaaataaacagcccggtgactatagagggatgggtgaccagggacaacttctcatctgacctgaggtgccacggtgaggaggaggcaggcgtcccaggcagaaggaagagcaggtgccaatgctcggtggggtagagagcttggctcctagggagcgtgagacctagagaagttgaaacagagtgagctcagcagtgcgtccctgaagggagacggcctgatggctcttggactcagaagggccctctggccatttggggaagtctgggctctgggaaggctgcggaggcagaagtccagttggaagttggctgtgagaaggaaacaggtgaagaagcaagatgcatttctgtcttttttgggattttatatcctgtgtatatgtgtatgttgtgtattcgtgtatgtgtgtatatgtgcttttactgtattttcctgcatcgtgtatatgtacatatgtacctgtatattcatgcattgtgtatatgtgaatgttgtatatctatgcatgtgcgtatgtgtgccatatattaatgcatatgtgtatttttatatgtcatgtattcactcgtgtgtatatgtgtgttgtatattcatgtatgtatatgtagtgtatttgtgcttgtgtatatgtattcatgcatgtgtgtatatgtatgtgttgtatatttatgcaggtgcgtagatgtgtttgtgtgctggttccaaaatatgaggacaaattgccaaatcaaagtgaataaatatttaatgaaatggtgttgcatgattcagcgagtcagctctggaacatttggactcttagagagctgtttgtcgattacctttaatgtagtgtgtgggtggaaatggtgtgggatgaacatgtaccgaaagttgctgatgtccttaaagaagccctgttggtatttccagccagatggcccgtcgtgggggagagaaagtcctccgaaagcagcgggtgctttctgtcctgctggctgcctcttgggaggcccctaggacagatcaggtcctgtttcacccttcgcatgcctgtcagttcatccacgtgcatagcagtgggtgggggtgcactgtcgtttcattgccaacaaccacaggggacaaagtcctttgtggtcccacagctaggaggtggcagatccaggattcaaacccagacagtctgactgcagagacgctttgggcactctgccacattaccacctgtgttactgggaaaagggagaactgatgctgggaggaacagcgtgttcctacgccggcccggcatggcggggacatgtctgcagcagggagaggtggccgaggttcccagtggtttctggttgcaggagccctctgtctcccccattgtccgtggcttgcttagtatccccagtgatgccgtgtgtgcccctgtgccaggtttttcaccagctaatctcagtccctggtcgccacgagacacagctttcacagaccacaaatgcaattattacaaggcaatttcagttagatttggggctgggagagaaaacagaagggtctcctcctcccatcaggctccgaatcgttccccaggagcacttaactcagacaaatggggaagcagccgcgtggagcctccaccgtagagctgcctgcaggggaagtggccgacctgctgggccacgaagcagggtgcaggaaggatatggggagctagtgatcctctccaagggggcagggggactccattaaaccagatgttaacagcaagaagttggctataacaggggacgggcccattggtggataatgaaaatataacccttagtaggcacttgctatgtgccagttccaagcaatgtacagtcgtgtgtcacgtaacaatggggatacatgctgagaaacgtgtcgttaggtgattctgtcattgtgcgaacatcatggagtgcattacacgcctggatggcatagcctactacacacctaggctctgtggcgtgacctattactcctaggctacaaacccccctacagcatgtgaccatactgaatcctgtaggcggtggtaacacaatgggaagtatttgtgtatctaaacatacgtgaacatgttaatagagtacagtaaaaatatggtgggcatggtggctcatgcgtgtattcccagcaccttgggaggccaaggcgggaggatcacttgagcccaggagttccagaccagcgtgagcaacatagtgacaccccatctctactaaaaattaaaacattaggctgggcacggtggctcacgcctgtaattctggcactttgggaggctgaggcgggcagatcacctcaggtcaggagttcaaggccagcctggccaacatggtgaaacctggtctctactaaaaattaaaaaattagctgggcgtggtgttggacacctgtagtcccagctactcgagaggctgaggcgggagaatcgcttgaactcaggaggcagaggttgcagtgagctgagatcatgccactgcactccagcctgggagacagagtgagactccatctcaaaaaaaaaaaaaaaaagtggtttcaggtaagagtggatccccagggcctcaaaccagcatctctctatctctctatctcttgtatctctctatctcttctgtctctctgtctctatctttcccacctccgcatttttccatattgctttacacacacacacacagactcttccctcttggtggcaagatggctgccagcagcttcagttatgtatcccaccagttccaagccttgaggaagaagaccttctcttttctagtagctccctaaaaatcccagggctgactcgctgcagttggcccagcttgggtcacatgcctttgcctcaactaaccagtttgtgcatgatcaccaggggaatgcggtcctcatgggagtcaaggatttgcacacattcctggagtcaacagtcaaggtcagcccgtgcaacttaaataaggaagtgttggtgcccaaaggatgacagagccaggcaggtgaagcttccacctagtgctgggcacacaggaggcagtaagtgctctggcctttcagcagatgccagccctgctgcccaggggcagtcgccagccagctcattgtcaatggcctttcctggcctgccattaattcctcttaatctgcctgccaaattttcccacccccacgccagcccccagcttgcccctcctcttgtgctgtccttgcctcgaaagctcagcgaatccaagcttcccaggcaccagccacctgccacaatttgggctgggcttttaatcttggttttaattccagctcattctcttggctgtatctcccagcccaggagccccggggcccatgctaatttgcttctcccacctccactggtgccggaataaccatttttaaaagtgccttggggaaatataatcaaatgagagcaaaatctaatttggcactaaaagcctctgactgaagccctgttttctagggcctggtggagactgaataatacaccctttttgggtttttaagggttgggggttggagaaaggaaagagacgtgaaaggggagatgctagcagaggaaacagcttgcattaagctgacatccgtggcactgaaaagaatgggcaggaggaggacccccacccactccctatgaagaaattcatatcccagcagccaagccaagaagctaaactccagcattcatcagaaagaccttggcccaagtcttcaagaaccagtaggttcactggctggagatttggaagatgtgggagtgtagcgggaaacccagttccccagtggggagttcagtgaagcctttttctctgactttcagttcacttttctgcaaactgagggggtgaaaatctgtgcttcttaaatgacttgtgatctgggctcctttcagaatgtgtcaaaagctgtggacttgtttccaggaaaatgcacaaaaggcaaaatctggcatgcaatgttccaggagcggtacgaaccctgccactcctcatgacagtctccaggaccctatgggatctgtcccctcttccccgtgatgtcatttcctccctccctcactgtcccccttgggttctgcgatgcccccacgtttgtactggcttcagggactttgtacctgccaattccctctgcctggaacagttttcctcctatcccctctgactcttgctcttcagcccagcgaggcctctcacagcactgcgtggggccactctgtcctatcattctcctttattttcttcatcgcatttgtcatcattccccactagaacatcaactgcacgagggcagaagggatcctggtggtcttgttcactcctgtgattccagtgcctgggaagctccctgcataccgtaggtgtttaatcaacacttgccgaatggatacaggcatgcataccttccctagggcagtgggaccccaaattcagcaatttcgagtgccaccatcatgaggtgtaccatgcccaggtacactgattctgttaacattttaccctagattgtttcactctggacttcagttgtttcaaaaggaatcttttacatcactgacagtattgtttgccacgagtagaaagtgtcggggctctgtaggggtgtaacaaaaacgcaggtaataagagcgagatctggtataaagaaagtgattttttattccaaagctagcttaggggaagaagtacagtcttcctgccttaagggtactgctttgcttttaggagcagaaaggagttgctttttaaaagggggcctggcatgaatggcacacaggggaggaattgagtgctgggggggtccgcatatctcactcgagtacttcatctaccgggaagtcagctggcagccactggtgcctttgtgggtggaactaggttgtaagggtggccagaagctctccacctgggagggagtttcgcagcaggcatactttgggttgtagtggaccattgtctctcgaggcaacctcccagtgagtgagagttccgctccagagcctctaagcacgtgattagatgaacttgccctgaagagagtgtctggtgtaggggagataaaaggttataattgcatttctaaagggcgaagtggggcacggggaaaatggagaaaaaagaagaataaaaaataataaaactgccggacagggtggctcacacctgtaatcccagcactttgggaggctgagatgggtggatcacctgaggtcaggagttaaagaccaccttggccaacatggtgaaaccctatctctactaaaaatacaaaaattagccaggtgtggtggccatgcctgtaatcccagctactcaggaggctgaggcacaagaattacttgaacctgggaggcagaggttgcagtgagctgagattacaccactgccctccagactgggtgacaagagcaagactccatctcaaaaaataataataataataataaaactcatctttttcttagaaaaaatgggaataccgatttatgtgggggcttattaaattttaccctcttccttgttgaggtcctgagccgattaagaaatcagacccaagagtcagctgatgaaagtcaacactgcactctgatgaatctggtgaaggctgggtttgagggcatggcttccttctgagagcatttgggcttcctgactaaactccagagtgtgacagacttcccactgatgcaggtccacacctctcctccccgcgcagacaggacaagcctcctgaaaactagccctccccgggggcagctcagtccccagaggaaaagcaagggaagggattgggctatgcatgcccacttcggcccttcaaatccactaggcacatgctaggggtcagcaaaccacagccaatggacctaaccaggccctccatttgttttagtaaataaagttttattggaacatacccgcccacttgtttatgtcttgtctgtgacttcttttttttctttctaacaatagggtttagcagttgtcacagagaccctttgaccctctggcccacaaagcctaaaatactgactatctggcttttacaggaaaggtttggtgacctctgctgtatattgtccccctcggaggaggtacgggagagcatggagagaggccaggagtgttacagaagtggagcccccccgcatggagggcagcgttagaggtgggggtcaaggtcacaaggtttaggaaatcttgtttcctgaactacacttggtctccaggggccttcctggctctcacaatatggctccaaagacctgaggggtgagatgctggagggttggaccataggcaggtttatttaaataagatagggtttctcagcgacgtatggtggctcacatctgtagtcccagaactttgggaggccgaggcaggtggatcacttgaggtcaggagttcgagaccagcctggccaacatgatgaaacctcatctctactaaaaatacaaaaattagccgggcatcatggtgcacgcttgtagtcccagctactcgggatgctgaggcaggagaatcccttggacccaggaggcaaaggttgctgtgaggcgacatcacgccattgcactccagcctggaaaacagcgagaccctctctcaaaaaaaaaaaaaagaaaagaaaagaaaaggtttcttggattaggcgctgctgacattttgtcctggctcagtctttgtagcgtgggggctgtcacgtgcgtcggcgaatattgagcagcatccttggcctccacccaccagatatcaacagcacaccaagttgtgatgaaaccaaaaatgtctccagacattgccaagtgtctcctggggacagaaattaccccctttctggccaagagccactgctttgaggagctggatgcattgaggcatctccaacattccaggtcccagagaaagagaagtgcaggcctttagcttgcccgggaatctcatgctgcctccactccatcagttactccctgacacctagccagggacgcccagtcgctgtttaattaggcacccaccacctaattacatttcactctgtgaaaactggatatgactcagactcagagactgcagccggttccccgcctcctcctctgcagaacgccaggttcttcccgtttatttttgctccatcctcccacacaaagggaggttccatcccggaccttacccctgaggctgctgggggatcctcccttcctattttcacctcccctgtgtacccagacccttacaggaggtgtttcatcagctcctccctctggagcggtcacctcccggccctgcatgatgggcaagtcatttaatgaagtgctcccctttgccttgtattttgggggtttcagaatccagccgcttgggttcctaaggggttttcccactcctggaaagtgtcagccatctgccaggtcaccaggaaaaccgctgcagagggagccagctccatcacagctcccccagggccaggtggctctgtgctttctccaaggacactggtggataggttgtcctctcctctaggggcaccagagccccatcccacccactctcctccttcctctgggggttcacctccctggcctttctctcttcatcctggcttctcggccaagcactcacgtgcacaaggcccagcgctgagctgtctgttagcaagatctccttacatccctacaacctcctggaacgctcatattctgtgctctcagcaatactcgtcagaaatttcagaaccgcagtgtcctcatctagaaagagacgactagaataggattgctgtctctagactcaaattttcccatttcttaaatatggctttatagattataattattaaaaattatacatgcaagccagacacggtggctctcgcctgtcatctcagcaccttgggaggctgaggcaggcagatcgcttgagctcaggagttcaagaacagcctgtgcagcatggcgagaccccttctctacaaaaactacaaaaataagccaggcatggtggcatgcgcctgtagtcccagctactcgggaggatgaggtgggaggatcacttgagcctgggaggttgaggctgcagtgagccgtgatggtgccactacactccagcctgggtggcagagtgtgacgtgtctcaaagaaaaaaaaaatgtacatgcaaaataaaaacagaagaggatcatgaagaggtcttgtctgtctccttatcacagagcttttaggcacatccccttcctgatgaattagggtgattttctttaagctttgttgttgatgtaaagcgtgcatgtggaaaagtgcatggctcccaaatctccaggccaatgaggtgtcaccaactgaaccacctgctccagcaagaaatagaacaagatcatcacccgagaaactccccttgctgctcccagccaccctcccccagtctccaggatacccactgtttttattctaacatcatagattagtttggcctgttctcaaatttcacatagatgacgtcatatggcatgtattcttttgtatctggtttatctctcttaacattcttaggttgttgagatgcatccctgttcttgaatgtagcactaggtctttcgttcaagtttcaatgtagccttccgttctgtaaatatgcaacaatttctttacccatccttttgttgataaacatttcatttgtttctacctatttactattacaaatgtgctgtcatgtcttgtacctgagtttaggtgagtgtatgaatacttttctgttgggtaaatacccaagatttaaattgttgggtagaagttaccaatgcattcaaatttagcagacacagccaaagagttccccaccgtggttggaccggttggggcagccactcagtgtgtgagggctcaagttgtcccacatccccacccatactaggtgttgcccatttctttaatgttagccattctggttgctgtatagcagacagaatccaagggatccacaaacttcaatgggaaaaaaagtgacactctggttttcactaacctacagctgagacttagcatttgcttccaatatgagcataagccataaaccacagtatgttggcagaatctgtagctttgtcatctgtagaaatcaccagtatttaatatcccattgcagtttttgcagatactgcaaaatataatattttcactcataactattctgaaatgatcgctctctacaaggttttaaaagacacagtaggccaggtatggtggctcacgcctgtaatcccaacactttggtcaggagttcaagaccagcccggccaacatggtgaaaccctgtctctactaaaaatacaaaaaattagccaggcatggtggcagacgcctgtaatcccagctgaggattactcgggaggctgaggcaggagaattgcttgaaacctgggaggcagaggttgcaatgagccaagatcgtaccattgcactccagcctgggtaacagagcaagactccatctcaaaaataaaaaataaaagacacactgtatcgcaaatgtgtttagtattttgataaccgtatttccaaacaattgattttctctgtaatcctatatcttgtattcaatgcacgtaataacattggagaagggatccattgctctgtgtgccagagggctccatggcagagcaggtgtgcatgctcaggcctcggacacacaatagtttaataaacatcgtcaggcactttctcacgtggcctcctgatccatctccctccgcagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggtaagctgcaacctttccagcctgggagtggctgtgtggcccagcagttagaggcccaactcaggagccagactacttgggttcagattgtgactcaggcacttaaaagtgtgaccttgagcattttacatacacctcctcctcagtttttcatctctcagccagggacagtggctcacgcctgtaatcccagcactttgggaggctaaggcaggtgaatcacttgagtccaggagttcaagaccagcctgggcaacatgacgagaccctgtctgtacgaaaaaaatacaaaacttagccgggtgtggtggcacatgcctgtggacccagctactagagaggctgaaatgggaggattgcttaagcccgggagtttgaggctgcagtgagccaggatcttcccactgctcttcggcctaggtgacggagcaagactctgtctttaaaaaagaaaagaaaaatgtattcatttctcaaaaaatagtgtctgtttccaagagtttggttttttaacattttgccgagacagaatattcttacagaaagtacatacacagagtgtaccattcaaaggcttgccgcacactgaacggacatgtgtaatgagcacccgggtaggccaagaagagaatgtcaccaccgcccgcagcagtcccctcacggaattcccccgactcgacacccctcccgcgaggataacgatgattcagactcttagcgttacagattcactctgcatctggcttctcctgcttagtattatgttgagttcattcttgctgcccagcattccatcatgcgcttataccacaatttgtttatttcttctacttttattgggcatttaggtatttccagtttggggttattacaaatagcgctgctgagcactgtctagaacctagctcctggtgagcatagaggctcatttctgttatacccgttcctcacagcagcgttgctgagcacagggcgtgtgcatgttcggagtgagtgggtgctgcctgagcacctgcagcagtggttgatcctcagtcgtagttttttctgtttttaacataagatgaattgacatgaggtaacatgcacagatcttaagtggaccgctggatgaattttcacatacgtgtgcatctgtttcaccgcgcatctcttccacatatgcgtgcatccatttcaccgcggctccgatcaagacatagagcacttccagaagactccctgagacccctctccagtcatgaccccccaccctggggatgacgtctactctgacttctgacagcgtggattatttttgcctattctagaacttcacctaaatggaatcgtatagtctgttctcttctgcatctgccttttttcacccagcgcaatgtctgtgagatctgtattatttattcattcaacaactcatggacattttggttgtctccagtttgggtctattataaactaagctgccgtgaacatctttgtccatggcttttagtggacatatgcacccatttcttttggttatacacccaaagaaggattgctgggacataggatgtgttaagatgttgcgcccggccaggcgcagtggctcacacctgtaatcccagtactttgggagactgaggcgggtggatcactttaggtcaggagttcgaggccagcctggccaacatggtgaaaccccgtctccactaagaatacaaaaattagccctgcgtggtggcgggcgcctgtaatcccagttactcgggaggctgaggcaggagaatggtgtgaacccgggaggcagaggttgcagtgagccgagatcacatcactgctctccagcctgggagacagagcgagactccatctcaaaaaagaaaaaaaaaaaaaaaaaaagatgttgcaccagtttacactccagccggaaatgggagttgccctgcatcccttatcagcacttggtgttgtcttttttgtcagggctgctttgttgggcatgtagcggtgtttcattatggttttaccacaaaggtttttgaggatcacgtgagttagtacatgtagaacattagaagcgccccttgcacgtagtaaatactcagtatgtagtagcttagatcagggcaacaaatattttctgtaaagggccagatactaaatattttaggctttacaaggcttacagtcctgttaccactgcagaagtctgccgttatagtgtgaaagcagccatagataatatacaaacaagcatggccatgctctaaggaagctttgtttacaaaaacaggcagtcgacctgcttggctgtagtttgctgacccctggcttagatgatgaggaggagaaggaggagaggctgacagtgatgtttcatccagatgtcccattttaaaagaaatatggaaatgaacaaatcttcctgccccatctgaatcctcagagtcagctctgacatccccccacagctggtacattctttccccagaccagctgccaaatccatccctctttctcttttcccatccccactgccaccagtcctgggccctgcctactgtgacttcccaggttaaagtcactagagaacaggcagtcactgaaagagggtagcaagccaggagtgtgtggacaatagggagtggtggagacggtggagaaggtgtctgtccaaaaggggcagatcaggcccaggtagaactgtgggcccagatggccacttttcctgatttttcaacagaagccacaaatttgtattttttacctatgaaatctcctgattggtaaatattggcaactaattcagacttttctaaaatcttgcatcaattgagcatgcctgacccatgggcctgcagcccttcagcccaccatgtcgttcttctgccagcaccctccggggactgtacggtgagtttcacatttggagtcagtgggatcaagttgagagccccaaccttgacacatattacgtgaccttggacatgctacgtactcctaagagcctcaactcccaaatctgaaaaacaagcatacccttgcatacttaatcatgtgtacttccatttactgagcacctactgtgtacccctgagcacctactatgtagtgctcaggggtacacagtagtacttctgataacatgtagtacttctgatattcacaacaatcatatgaggggagtggactagtcacatttggttccattattcattcaccacccccaacaagtattcattgagagcctgctgtgtaccaggtaccatgccaagtgctggctattccaaggtgaatgaaaacagatgacccaatcatggtcctcctggagctcacagtctggcacatgaagatatgatataaactgttaagtgatgtgcacacatcattaatgcacacacacacagtcacatcacacccgtctattttgtcatccccagtatgagccatttcaacctccaagcttgctagttattacagtcatctcagttttgttttgttttttgagacagagttttgtgcttgttgcccagactggagtgcaatggtatgatcttggcttaccacaacctctgtctcctgggttcatgtgattctcctgcctcagcctcctgagtagctgggattacaggcatgcaccaccacgcccagctaattttgtatttttagtagagatggggtttctccgtgttggtcaggctggtctcgaactcccaatctcaggtgatccacccacctcagcctcccaaagtgctgggattacaggtgtgagccatggcacccagccactatagggtaattttttttaatcagactaggctcttgaagttgtttgtgaacagaaatttaactcccagtggcttaatcaaagaggaaatatattcacctatttaactgaaaaccagctataggggtatcaggcatgggtggatccaggagttcaaatgaacccccaaggagttgatttctctctactgtcagctctgtttttgtctgctcgactgtattcacagaagctctctctcctcctggtagcagtgcggccttccttatatcctcccagcttcctggccagctgcaagcatgggagtctctttcccaggagtcccagagagtctcagtgcatctcattggctctggatcagtcccatgtctgtccctgagccaatcagagtggccaggaggatgcctggttccctggactataagtcacatgctccactcctgagccagacatgggggtagcaggagctctacgctggaacgttggctgggaatagagccccaaataagaatggagtttccaccaggagaaggctgactaggtgctcaacggccaaaaaacactctgtcccacttctgttctggaaaccccggcacacatggagatccctctgcctccgacaggtcatcctgggctccctgtaagtctgatgggtccaggcccaagtggcagaagccgcccccggcctgccctcaagtctcattctgcacatagtaggcctccagcctcccaagtgaattaattccaaagttctgatgaggcagtccggcatggactccttggaatataaattccagtcccagggctaagcacgctgtttccctcctcccagcctcagtgcaggcggattctctaaatatcctgaaaaatacattccctcctttttaaaattcttcaccacatccacgcctcatctcagagcagcccgataatcaagttatcccggggtgctcaggattcttttggggctaagcatggggacatagaacgtccgtccttttgccctgtttcctgcccacacacatctccccctgtgaatgagaacagccctgtgagggaggcgtgagaggattcctggccccccagttaccaggggcctgggaacagagatgctctaacagggacgtgggcagagggcggggcggtgaagtcagaactggctcaggtccagggttcaaatcctgagggtagcagtgggcagcaggagcccaagcgtcaagggaacaggggtgagcccggggtttccagccaaggcagagctcaggagccctgtgccctgggccctagatcaggcagtaagatgcctctggcaaggcagaatgtcactgctggcctcgggcgggccttgttgggaggcccaggcagggaggaagcggcaacccttcgtaagcccccctcagaaggcctctgaggactctgtcccaagtcactaatccacagatgggcacatgccaccaaaggggtccagatgtcaagggcagaaagagaggcagtggtgatgagaaaagagtgatacaggacaagcgctaatggcagaagagggttggagaggggaagacagttgttagtgggaagggaagtgagaatgacctagagttgagtccacccgaaaagaggcttccaggtagctggcaaaagtgggcctgggtgttgggtggctmtgcagggaggtgatggcagtgcwcggccagtgtgggggcgacctggcagattctatgaacttcatgtgccccgccccttgccgcagcgtgtacacttctctgtctatctggagaagcctcagtcataggcaggagacggcgtgatggagcagctggttgtagctctgtttattactgaaagaaattagcaaagtccaccaatacacgaaataactaaatgaccgtgaagcatccctcctctggaagatcctcggcaaaggatgaggccggtctgccttatgtcctgagcccatcaggcagagtgggaaaagcaagttccagaactcctgaggtccttattcaaatgtcacctcactttagccttcctggaccaccttgtataagggcacccccaccacactccttactgcaacaaatcaccatctggtgcattacaccctgtgtatattactgattcatttgttaagtatctgtctcttctcataagaatataagccccatgaaggcaggaatgctcatttgttttgttcactgctgtatttgtcagatagataaatgaatatgtacagtatgatgtgattaataatataaaaagatgcataaagtgatactataatgtacctaacaaaacactggaaaggttattcccagtaggggacagaagagccaaggttatgggggtgggggggtggtaaggagtaatctaatcaaatgagacttcactgtcctttgtactattttaattttcacaaagaaaatgtaggcatatggttcttgaggaataatgactaacactcatttagacataccatgtaccagatactgtttgaatcattttacacaaattaacccatgcatttctcatcatagtctgtgaggtatatactgtgtctattcccaactgtcagatgagaaaactgaggcccagagaggctaagtaatgtaaccgggccacatagcctagtaagtgataaagcagaattcgaacccaggccatctggcttcaaagtccatgcactaaaccacagcccgtgggcccagactggtggtttttgtatggcccctgagctaagaatggtttttacattttcaactaattgaagaaacaatcaaaagaagagcatttttcacatggtatatacaaaaatgaatgtcattcagcctttaaaaaggaaatccggccaggcgcagtggttcatgcctgtaatcccagcactttgggaggccaaaccaggcggatcacttgaggccaggagttcgagaccagcctggccaacatggggaaaccccatctctactaaaaatacaaaaattagctggacatggtggcacatgcctgtagtccagctacttgggaggctgaggcaggagaatcgcttgaacccaggaggcagaggctgcagtgagcccaggtagcaccactgcactccagcctggccgacagagcgagactctgtctcaaaataataaaataaggaaatcctatcatatgcagcaacatggatgaaccttgagaacattatgctaagtgaaataaaccagacacagaaggacaaatactgcatgattcccttacatgaggcatctaaattagtcagacaatagcagcaaaaaggagaatggtggttggcagggctgaggggagggggaactggggagttcctgttcaagatgtatgaggtttcagttatgcaagatgaaacagttccagagatctgctgtacaacatggtgcttagagttaacagtactctacttcacagataaaactttgttaaaaagcatacagctcattttttttttaccacaataaagcttttaagagtaattttcatgacatgtgaaaaatacatgaaattaaaactgcatccatacataaagctttactggagcacggacatgcccattcattttcctgatagctgctttcaagctgcaatggcagtaatgagtagttgcaacagagacagggggcctgcagagtctaaaatatttactgtctggccctttacaggaacggtttgtgcatacttgctctaaaccactatgtatgcttctcattaataatgttatctgtggcggggagaaaaagatggacctgacccaaaaatacaaaggccttggctccagctctggatgcatggcttatttgtttggggacctcacttccttatctgtaaaatgggtataatgtccacttgtcaaagttgctgtgacgatcagctgagctaaggtatttgataacatgaagagcctatgatcattcattacgagttgtctggagcctgtggagctgctgccacccacacgcactgccttggccttggagggaagcccggtgcggagtgcccactcgagggaaacacgcttttgcctagggctgaggctggcagtctccgcagacactagctactcagtcggtgaagcttgtggatgcctgcaggaatcacctgaggctcagagggtgcttgccagagggggccggttgcacctcggggtcccagctgtggcttctcagccctgtggagctgtgcaggccagcagcacctgggtagagcctgactcctgggcgccgggttctggaaaatgcacctgggcctgtggacctccacccatctcaccctcctgctcacaggtctgaatttcagagttcttcctcatggcttgacccgggcaccccaaacacagtttgcccatctctgaactcagcctttcccccggcccaggccttctctacccttccctcaactgcccaaaccagagaccaacaggggtgggggtcacccgcccctcccgcaccccacatccacccagtggctgtcctggctgcccctgagcatcgctggatgctgcccccgccaccctggcccaggcctcctgttctctccctcagagagaacagggcatggctgaagccctgtggccggagggatgggtggctcttgttggctggcctggcactaactgcccactggtggagcagggtggcagctttggaggcaggtgtgtcatgtggcattgcggagctagcagagatcggggaagacttagccgaggagtggccactgaggaggatggataaggaggggagctctcagacatggagaaatctgcccagccaccaagacagtcctgattcttagctgaatggtggcagagagctggctgtgcacaggacactatggcaagagcttcacatctattggtgctttaacctgcctgtcagcctcaagaggcaggtactgtaatcaccccccacacactttgaaacattagactgtgggagcccctgacccaccctcctgggtctcattcctgccccggcctgagccctcccctggaggtagccagtatcctggagcttctacccacacatacctttattctttcatcccataggtggatatctcaaacaatgtacgatgctgtgtttgtgtccttagactttttataaatgatatcatatcatacacatccttccacaacctgcttttctcacccgatataacattgtaagatttatccacgtttgatccgtgttcatccacgtagctctgttctttttcactgctttagaatcccattgtatatcttctcctaggaatggaggttaatggtagctttatttttaaaaaagtttaaccacggccaaacaggcatatagttctaagatgaagtagtgaagatgagtctgttatgaagagcaacggtggcttcccaccccaccccactggcgggtggcagcaagtgtccaccactggcggttccatctcattctcatgccatttcctgacttgaccccttcaggccctgactgttgatgtcagggtacagagctttgcaccatttttagatccattgtaaattacctttgtcattttaagaacttttctaatacctttatatcacgttccaaaactatagcagcagctctttgatttatataacatatattatttttatgtaataaattctgtagagcccccttataaaattgtttttactccccaaaattaatccataaataatattcaaggagcaatatataaagaagcaagtaactttctccgcttctctcctcttcccagtcttcaatcagcattttgatatccttccagatttttccttgatgctcaaaaatatatgaggttagagtttggtttctcctcttcaccttcccttccctctgcccccacaaaaaatagaatgtttctgagtttgactctgttgcttgctcttacccttaaccatgtatcttggacaactttacacatgcctttttaatgtctgcacagcattgcatagtatggaagcaatgccaccaggtgtgttggctcatgccttaatacctacactttgggaggctgaggcaggaggattgcttgagaccaggagttgaagatcagcctgggcggccacttgctagctgtatctacttgggctaaccactgttagatactcaagactctgtctgtagagaccctgtctctacaaaataagaataaaaatgaaaaattagctgggtgtggtggcacatgcctatagtcctagctacttagaaggctgaggcaggaggatcacttgagctgaggacctcagggttacactgagctatgattgtgccactgcaccccagcctgacagagcaagaccttgtctctaatatgtatgtgtgtgtataatatatatacatgcatactgttaaacatatatcctcctgctggtcactgcaatgtttttgttttataaacaatattgcagtggccattcttgtgcatatggatatagtggatgagtgtacctgaaagagtgtctgtagatatatgaatacatcatggtatgtatatatgttgtatacttcagggtggaagctgtagacacctcttcacctttttttcttgaaaataatcactttttgaaagtaattgttttgggcagagctgctttctagcagagggtatatttcaagaagtcattaccttgaagaaagattagcagctaaatatttactaaattcaggaagagttgtatgggtgctgtggctcacgcctgtaatcccagcactttgggaggccaaggtgggaggatcacttgagcctgggagatggaggctgcagtgagccatgatttcaccactgcactccagtctaggcaatggagcaagaccattgctccattttttgctccatgaccaaaaaaaaattaaagagtataggcaaacctcaacttcttagctgagcttttaaagcctccagttctggccatttacttttcctccaactcttctctcctcttgcccaatatgtaagtcagttccttattttcctggagacattactgcatccccatcccttttttgtgtgtgtgctgctccttatatcatttctgcattttaccctctgacattttatcctctttccaaggagccagttgccatctgccctctcttctatttttagagcacatggcaagcacattcctgcctcagaccccgttatctctgcctggaactctttcctggatcagtgattctcaatcctgagtacccattagaatcccctggggagttttttaaaagtctgatacctgggccaaaccgcaggccaatccaaccagaatctctgggggtgggcccaggtatcagtaagctctccaggggattctggcaaaatccagtgatacatatcttcctatgcccagctccttctcatcattcaggtctcaactcaaatgtcacctcctcagagaggacctccctgactgccccagctaaaatatgcccctcacctcagctcccagttactctttgttacatctctctgttttatgatatttccttcatctgtcataacttttaactaccttggttctttatttatacatgtgtctgctcctgccccagtgtaggcaccccagggacttagggatatacccaccctgcatgacagtgtccccagagccttgaaaaaacttcagacttaggagccaagactatgtagtgctgggtccaacatttactagctgtgtgccattgggcaatttacttagcttctctgtgccttaatttcctgttctggaaaataaggattatcatcatacgtactttctatagttatgtcagaattaagcgagcaaatacaggtaaacacagaacagtccttggcacatcgtaagcactcaatagtgttagctattattcttttaatatctttttttttttttttgagtcagagtcttgctttgtcacccaggctggagtgcaatcatgcagtcgtggctcactgcagcctccacctcctgtgttcaagcgattctcctgcctcagccttctgagtagctgggctacaggtgtttaccaccacgcctggctaatttttgtatttttagtagagatggtgtttcaccgtgttggccaggctggtctcaaactgacctcaggtgatctgctcacctcagcctcccaaagtgctgggatcacaggtgtgagccatcccacccagcctattttaatatctatctaaagtgatctattgcaattcctgccctgttctccctatccacttctctgctttatgtccaattagcttagcaccatttgcatcatttgtctggcatttcatttattttacttgcttatttcttgtctgtctgctccctagactgtcagctccagaagggcagaaattgttttgttcactattgtgtccccagtgcctagcagggtgcctggcacgtagtggacaccagtatgaatacctggctcctcacctgttctcctgtctctccccaccccccaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatgtaagcctcagcactctgcctgccagaggcactgcttagcatgaagggggagggtcaggctttagcaacagtactgtcaccaccatgacttcactgtgcctcctctctaatcctcctggtttaaagaccccaagaacatactgcttgtccatggtgaaactgggatgcaactccagacagcctgggcaacagaccaaggcaggagaatttttaacttgggatacacggcctcccaccaagaggtgtgtggatggaactgcatagaataggtttccttttaatgccatgtgtattttatttaagacatctaaaaacattcttttgaggagggggtctatagttttaccagactaattatttgccaccatttattgagctgtgggctatgtagcaggtgctgtgctaagcccttggcattattgtccagtccctgaatattcacagtgacccttggtgtaccagttatctattgccatgtaacaaatcatcccagaatctagcaacttaaaacaacaaacacaaattatctcacggtgtctgtgagtcaggaatctgggagtggctgttctgagcttctggcccagggtctcctgaggttgcaatcaaggtgtcagctggggctgcagtcacctgaggcttgactggggctcagtcccatggctgggtcttgccacaggagcctctgtccatagggtgtttgagtgtcctcacagcatgatagctggcctcacccagagcaaatgatcagagagagagtaaggccaagaaggaagccacagtgtcttttacaacctaatctcggaagtggcaccatcactgtgccacattctattggtcacacagaccggtccttctacaatgtggagggtctacgcaggggtgtgaaggccaggaagtagagattatcaaggkccatcttggaggctgcctgtcacacttggtattcccattttacagatgaagaaactgaggcacagagaggtaaggtaacttacctgaggtcacccagctctaagtggcagagccaggattcaagtccagccccccacttctgcttcccatgcctctgcccacccctgtagtactctatccagctggctgggaaacttcctggaaagttctcctgcttctctctgcctcagaccaccccctgcttagcagtgactcagcagcccttactgtgacattctggggctgcaaggatggggtggtttggaatctgcctgaatattcagggtgtttggcttcattacaatctgaatacattgccctcctcaagcccctcctgtaattactttttgacagacctcgaagcagctcagagagggtaccgaaggcactgttcaccttcccatcccctgatctctggggaggaggctttgacagaagacgatgagctgcgtcccaggggctgcagcattgctgctgtgcacatctgtctggctccccctccaaacccaagcccactcctctccacccaagaaggccagcctcccccagcagccggcaccccgccctaccgccacttagaactcatccctgcagcgggtggaggccactcagccctgtctaagggagaagccgtgggtgagggaagggacgctttgcttcggcagcatctctaaaagaggtgccggcttcaccccaaacagcagcgagcggtgccggaatttcatgatgaaattgtttggcattgcctgctggtttattttccctttgaaatgaaaattacagaaattgaaaatgagcagtgtctgctcttatgtggagaagccccctttgccttcttaggggcatgtttggaaggctgtctcatctctggagtataatcatttccgaaagaaaccaaaaaagagaaagtcctgcagctaggatgttaaatgatgacagtcaagaaggggtggagaggggacagagccggggcgcacggttagagcactggatctttctgttaggggtctcctatcccatctctcccctagaaagccggcacatgccctttcctggggcaggccttgtgtactctggcaaaagttggtagatggtggtaccatccaccccgcagaccccagggccctgcaccctccccatgcacccccccacacacacagtcacatacatacagacacacacaaagacatgcaaatacacacaggcacacaaagacataccacacaagcagatacacacaatgaaacacacacaagcctgggcaacttagtgagactctgtctctacagaaaatttaaaatcagccaggggtggtggtgcacacctgtagtcccagttactggaaaggctgaagcagaaggatcacttgggcccaagaggtcgaggctgcagtgagctatgattgcgccactacactccagcctgagtgacagagtgagaccctgtctcgaaaaaaaaaaacacacacatgcagacacacaaaaatacacagttacagacacacacaaagacatacacacacgcaaacaaagacataggcagagatacaaagatacacacaggcgtgcccacagacacagcccaccagccctcagagcttcccttcaaagggcgctgattgtggcttcaagggctttggggcgagggatgttggggctgctgctgatggccccagacacacagtggaggggctgtgaggacaccaccatcttcccgccatttccccagcagaagggaagggggatggtcttcttcacgcccttttgtgaacgcaccagatattcctcggatgctggaggaggtgaagttttcagatgtttgttgaacaggcagctgggcccatgggaagatgccgacatcctccctgggggagcctggcttgacacaggcaaccagcaagctggcgtcgaccccaagcaccacccggctctgctgccttctggcctcagtgtccttctccaaaagcgctctctccgagccggggctgcagaaatcatcatcctctgaacagtcacccctcactgttctcgagggccgatgtcagcctaacttctcatggattcagggatgattgctgaaaattgcatcctggaatccgggcccttgggcctgcgggaccaattttcccacacgctcgctgctctgagagcgtctctgtccgactgctgcccccagcagccccctttcagttcctcggtgggagagatctgagaggggagctgagcttgttcctgggaatgttctacatggcgggtcaggccctgagacagcagagccagcccacaggagagcctggccgttctgtaatgaaaggaagcatgggccctgatggattcagtggcatgaggctgcagatcagccaggggctgagaaagccgagtccaggggagccttggagacagtgactcacctcccgccttacatagcaacggtgtccacagctgccaagctaccccagcggcagcgtcacaatttctgccccggacgattgtgatatctgagacgctgctgaagtcccgacgtaccaggccagagggagacatgtctgtgcccctctgaccaggcttgtttttcctcctcttcttcgcgggagctccttgcccccagaacacccactgtgaaaagcagtggaaactcaccctttacttcagccttgactgggaagagaggccagatttgcagggaacctggccttcaagaaccatcaggcccagggcgaggaagcccacgttttgtgaggccttaaacagtgcctcctgtcaatggtgcaccccacccaggagactcccccatgctgcggttttcagtagctcggagccaggggcccggcataaactgaggtgacaaggaggtgctcttggtttgctcacaatgtttcctctggttttggtttaatctcccattgactaaccaggaaatagagaggatcagagaagtttggggacctgcccgctgtctcacggagtgagtgacagacccagtgtacctgacttctgccgtggagtcacccgtgattactaatgacaaagggacacaccaatgataacctctcccaagcagtcatcacgcactggccatggttagaagggttccccttacagcctctccctcagtgctcacaaccttcctgggaactggcactgtctgtattctccttgggtaggaaatgagggaactgatgccttgggaggggactaactggccaaagacagaactggggctcgaaccccagcagctggtatagtcaaccactgccatgatatcatcatagatacctgcttggggtccctccatccctcacatcacaggtgctcagacagaactttgcccaacacactcctgctgcacgattaagcagcatgccaggtgcagtggctcatgcttgtaatgccaaaactttgggaggccaaggtgggtggatcacctgaggtcaggagttcaagaccagcctggccaacatggcaaaaccccatctctactaaaactacaagaattagccaggtgtgttgacacaagcccgtagtcccagctactaaagaggctgaggcaggagaatcacttgaacccaggaggcaaaggctgcagtgagctgagatcccaccactgcactccagcctggaccacagcaagactccatctcaaaacaaagaggccaggtgcagtggctcatgcctgtaatcccaacactttgggaggccaaggtgggcagatgacgaggtcaggagatcgagaccatcctggctaacatggtgaaaccccatttctactaaaaatacaaaaaaattagccaggtgtggtggcacgcgcctgtagtcccagctacttgggaggctgaggcgggagaatcactcatactgggaggtggaggttgcagtgagctgagattgcgcccctgcactccagcctgagcgacagagcgagactgtctcaaaaaataaaaaagaatgtggcatgtcccaaatgtgcacattcaggtgccttcctcacaattctggccttacacataaaactatgacttatttcatttttaaatccatttctattatttcaaactaaaatctattgcaaaaggatattccgtggtcctaccttaaccacaataactgccacctgccattcaccaaaggtaactgccatctaccaataataggtacaaggcacacaaagcaatgctatggaatttgagttgggtactggttcccgatgaaggctctgaacttgactttcttcccttttttcaaaaggaagacgagcaaagtctagagaggtgttaaagaaacactagcaccaaacagactttgccctgagagagccgacaagggactggctgtctcactttgtcactcaaggtcactgaatgctgtgcctcttaggagcttcccaagtgcacacttcacacgtggagaaacgctgaaacagggtttggataagcccctgacatgccaatgtcccctttcccaccaggagatcacacctggccctgggctgcagacacagcacagggtggctgctcatccgggcgggtctggcgggggccaggcagggtccaggctgtccctgggtttgaccgatgtgtatgtccttgcccaccagcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacggtaggcgcccgctgcatgcctcttggtgggcgtggctccgaacccccagccaggccagggccgagacctcctggcccttcagggttttcctggaggaatagaaatcaaaggcrgaatgaagaggccccatgtgctagacctggggaacagcttggagcaatccagacaaaagcctcttccttcatgaaacattttctagatctgtgttgcccaatacggtaaccatatatgctagttatattttttcctgctatttacatttttgaacacatttattgggatgtaattcacataccatacaattcccccaattaaagtgtgcaattctgtggttttaatatgcccagagttgtataaccatcaccacatccatgttaggacatttttcttaccccaaagagaaacctcacagcccttagatggcccactaaatctccctcacccccagccccagacaactggtgatctctttctgtctctatagatttggtgttctgcacacttcctataaatggaatcgtacacgctgtggccttctgtgcccagcgcctttctttcacttagcgccacgtgttcaagcttcacccctggtgtcgcatgaatcagtccccctcattccctgttattgctgaataatatcgcattgtatgggtattgtcacattttatttagccatggctatttaaactgaatgcagtaacattataaagtcagttcttctgtcacacaagcctcatttcacatgctcagtaggttcgtgtggctggagccaatatgtgtccatatcggacagtgcagacattaacacggccaccaatgcagaaagttctgccacacggcgcccttccagatcgcaagatcctgccataggctgcagcccaagtttcactcattcattcattcacctgacagcattattgagtgccagtgtacgtgggatacagcaggcagggaacaaaatgacaaaagtgtctgccctaatggaggcagcatgccaaggcagggacacagatgatccacagataagtaaaagagatggatgccaagaagggccatgaagaaccgtggaggggagggcgggccaggggtgacaagaggcaggaaggtgcagtgacaaaggggacagcccctgggaaagttgagcaaagacctgaagcaggggagggacggggcctgagatctcaagcgcctgtcaccccgggtcggagacgggccaggcacccagtccccactgtcccttgcctcctcgcccgtgttgcagatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgtaagtgtgtcatcccccagggacccagggaggcccctgggcccagctcagggcttcaaccatgcagcccaaacccaagcccaccctgggtggcacacagttttcgcagatgtaccccagggccagcggaaagcaattatgtcatgcatgttatatccctctgctggggaaggagaggccgggagctgttagcacctgtggaaacaggtgtggtggggccgtatgccaggaaatccagggagctgggctgtatacgtgtgtgcgcgcacatgcatgtcaccagcgggtgggaatggtgcttggatttctgttctgggctgggcagtctttgagcctggaggttgtcagggaggaaccccggaccacagcacaggcagctggttgtcagctgggatcagctgagccaactctgggcagcagcacaaagggaaatgctcttccctcccatccttcctggaggaccacgtgggccgcagccctcagccagccattctcctcgggctaacctttgagttgacatgttctggcagcgaacatgctgcgtctggggcaggggagcggacaggccactgttcccggcagcagcttccttggatcggctgggatattatggaggctggctcaaatgaggtttttgaaaagcagatgtgttgctattaagactgtcatttggtctgccttctgctcatgcccagatgtgggaacacacacccagcactcacacagggctggctgcggaattcctcctgaaaaggcgttgacagtgcagtgtggaattccagactgacatgttcccactgccttggacattttgcgagaattccaggaggcaggctgcatgagttcaaggccagagaaagtgatgactgactgttgaccttatcagatcacgcccgtctttggctcttagcgtccccattggactaagagctgtaataacgacagtccacacgtatggagtgtctactcttcagggcctggtctaagaactacataataattcattgcaagccgggccctgtggctcatgcctgtaatcccagcactttgggaggcccaggtgggcagatcatttgaggtcaggagttcaagaccagcctggccaacatggtgaaaccctgcctctactaaaaatacaaagattagctggacatggtggcgtacacctgtaatcccagcactcaggaggctgaggcaggagaatcgcttgaacctgggaggtggaggttgcagtgagccgagatcatgccactgcactcgtctgggcgacacagtgagactccatctcaaaaacaattaataattcgtttcagcatcacaactgccctgtgacgtggatgctcatagtagccccattttacacccaaggccactgaggcacggagaggttaagttgcctgagtttacagcaagtaagggaaggggctggggcttgaaaccaggcagtctctattcccatctgccacgcctctcagaaacttcaaaccatccctgtgaacagaaagaatctgacccactgagggctctacaaacactgacattgggggtttggtcagcctcggaatctgtgatctgactcatagggcccaaaaccacatcccacatggtcaagaaaaagagagtgctcatgtcaggtttgggaccaaagacacacggtatctgtcagccaggactcctttggttgcaagcagaaatgacctttgaaccagataaggcatgtaagataaaaggaacacagtaactatagttactgaaaagtccatgcacagctccagcctcaggcatggctggatccagcagtcttacaatgccattggaaagctctcatttcttatctctcagtcccacttccgccgaattggcttcattctcaggtgggtttttctccttgtggcagggtcagcagctccagattttcagccatcctgtttaggaagccaaactgctttgaacagaagacctgaggctgactcccactggcctgacttaggtcacgtgtccttccctgaaccattcactgtagccagaggtgacagaaacccttgagtaaccaggctgagtacattgggcaggggactctgaatggggccaggtagttcctacagaattagaagctgtgacacagagcaaggcattggtgctggccaggaaaagcaaccactgtcctccttcccctgagcctgggggagcgggaccactggacaagctcagccccattagctgccggttgctgggttctgcagagcgcccgtcgctcagcagtcttcccagctccctcgcctctggattcagttgtagcgcctcacgctggccttcgagccccccatgacacagccccatcttcagcagctgcacacatgcttggcagcctgcccgacgttcacagggcactggactggggagagatgaggggttaaagatgacggaaaccctaggacccaggccctgccctggtccccagggaactagcggggaaggcactcagatgctctgacgggactgtccaccattcaacaggtcctgggtcctgtgctgggcacaccccttaagtcccttaccctacattgggaatgccatcagccagaaacaagagccaggagaggtggctcatgcctgtaatcccagcactttgggaggctgaggcggatgtatcacctgaggtcaggagttcaagagtagcctggccaacatggtgaaaccccacctctactaaaagtacaaaaattatgggtgtgatggcgcatgcctgtaatcccagctactcgggaggctgaggcatgagaatcgcttgaacccaggaggtggaggttgcagtgagccaggatcatgccaccacactgcatcctgggtgacagagcaagacacctctcaaaaaaagaaacaggagccaggaaaggtggcagatgtatgggaattcacttagccaatatttactgagtagctcctctgtgttctaagggtataagtcctggagatacagaagtgaccacctgagccagccttcctgcagcttagagtctaactgggcaatagacaataagccagagaaataagtaaattatatagcatatgagatggtgataagtcttcaggagaaagataaagcagggagggtggggagggggcgcagttccgaatagggtcctcaggaggggccttgtgttgggtatctgtgctgcagaacaaactgccacaaactcagcagcttaagacaacacacatgtacaaactcacagtgtctgagggtcagaagcctgggcctagccctgcagggtcgtctgcttaggctgaaatcaaggtgccggccagggctgtggtctcatccagaggcttgactggggagcatctgcgtccctgctcatggggcaggtcaagtgcaagcagaggacttgaacccatgcagtctgcctcccagactgctcacagtctagctgctgatttagagtggcttgcttcttcaaagccagcaaggggagaaagaaaccagagccagactgctagcaggatagtagttgactatctcataacacaaccacgggagtgacagcccatcaccttcacaacccactggttggcagcaggtgcaggttggtccacacccaaggtgagggggtcacattaaggtgtgatcaccagggacagggattctggggaccactgaggcctgtcacgggcctccttggtcatagagcaaagaactaaaggggtgagggacggtggcccctgatctccagggaaaggacattccaggcagagaggatggtaaagaagaaggccctgaggctgcactgtgcctgggctgtcaaggaacagcgaggagccagtgtctgccccagaggttcaggggaagggttcaggaagggccaggatttgggctggctgtaaagggggggtcgccttcactcaggaagtggggacaggaagggcaggagggggacagggtgaggctgtcagctcacggcatgagctgagacacagaaactaagggggggcgagcacagagtgggggttcagctgaatctgggccgcagaggggagctgctgaggttgaggtgccagactgcagcttccatacctgcagatgtcagcctcccacaaactgctgcccacctaccgctccccaccccccacgcgaggctgaggcaccaccacctgagtgactgagtccccgatctcctgcctcccccaggaatccccacatcgtcctcaacattgacctggcccccaccatcctggacattgcaggcctggacatacctgcggatatggacgggaaatccatcctcaagctgctggacacggagcggccggtgaatcggtgaggacggagcagggcaggtgttgagggggccgggacattgacctgcgggaactcagagcaaaaccctgtgggtctagaacgtggggtctccaagggtcgggagctggggttctcaggtcccgccatgccaaccacttacctgctgtgggagagaagcatggtcccctctccgagattctgtcttcccatctggaatgtggccaaggtgaccagttggggaccttctctgagctaaaattacccaaagcttgaaatgatagcagcagtgatggtaggagatggtgctaactgcacggcgcttgtgtgtgaggccctattctaagtactgtgcagggaaatctaggaatttgatcctcacagtaacccagcgaggtggacattatcatcatccccattttaccagtttggaatctgaatcccaaagcgattgagtgacgtgtcggaggtatcccagcaagtctggatgtagctctgggaattcagatgctgactcaccacgccccataactttaatgctggagggtgtgatgggaacatattcctaggtgtccagagaggcagaataggaaccgtgagggtgagcaagtcagacaggtgggaggtgggctgagtcagggcggggaggctggtgtggccgcagcgacatctggtggccagcgctcttaacagccaccaggttcctggcctccaggtgctacttcaactcctggcttgcacctctggcagcggagcccttcccctgtggcctcccagaggctccagccaggcgagcactgtgtgcccacatctggctgccctgtagggggaccgtgtccattgaggctcctcccctgactgtgaggccaggcaagctgtaatggtataaaatggacatgtttggggacactggcctgggagccaggacacctgggggtcaggggacagggtggaagcttcccctctcagcttcagagtccccatctaggaaatggaaatgaccaggtggcactggatgaaacatacaaattacatacatgcaactgcaaagcaccaaagaagaaaatactcccaaaacccaatgcaattaacctgacatcaaggcaaccactgcgcctgacactgagctcaagacagagctcaagacgccaaaccactgcgcctgatgctgaaccactgcgcctgacgctgaactcgagatagagctcgtctagtgccgggggagttgctgggcttcctgggrrgggcttgatkatgtgtgtgcgcgcacacacacacacacacacacacacacacagttacttgggtgggacttacagtgattttgacctgggtcatttctactgtgtgtgtctccagacccaagtctctggggaaggggtggctcaactcagaggagggtgggcaatgctctagtgcccagctgggcacactcaccacaattgctgtccaggctgaccgtaaaccaaggctgactcctggtgccgtccctgctcctgggggaacggggggtcgtgggaagccctcatgttgctgagaagcaggagccgtgcttttttccaggtttcacttgaaaaagaagatgagggtctggcgggactccttcttggtggagagagggtgagtgccgggtcctgggagggacacccctgcccacctccctccctctgcccaggaagcttctgtagccccaccgcatcatgctattcaggagctgcccatggctctgaagttggtccaaaggcccctaaacacaaagcccattcactgctcctatagacacagaattggggtctgaggtcacgtgtacgcttttggcatgctttgtccagcctctacaatgtcttcaatttatttaatttattgccaactcatgcaatttgggaagtttcttataaaattccaatgtcttaagtttcctaaacatcagaagacccgggcaggtggccctgcgccctccactgtgaggaaaagccggagccgagggggcacccctctaggtgggcacacatgcctccggggctcctccagagctgagaggccggccccgcggctcctgctctctgccccatagcaagctgctacacaagagagacaatgacaaggtggacgcccaggaggagaactttctgcccaagtaccagcgtgtgaaggacctgtgtcagcgtgctgagtaccagacggcgtgtgagcagctgggacaggtaagaaggctcccttccctcccaacggctccccctcctgactgcagccggccctgacctgcgaggctctgagagccgctgagccagcagggccagggcctcccaacgggtagtcctttgctgccgtgtggtgcccaagatgctgtttggtggtgcaggatgatgctcacaataagtgattcatttctcagcagcctttggaccctgaccgtgtcagaggccaagtgtcccgtgggtgtgtgtatgcccttagcgcctctctagcccttgccgatctctcttgcacgaaggccccagcaggagttaaattattttattttcaccatattcactttgacagtatcctctttgtgactggttttccttttataggagtaataagacatggctttttaaaataaatataggtaaggttttaaaaagtgaattgattgcaagagaaatattaaggaaattatggccaggaacagtccgtggctcatgcctgaggtcccagctactccagagctgaggcgggaggatggcttgagcccacgtgttggaggctgcagtgagctatgattgcgccactgcactccagcttgggtgacagaataagaccctgtctctaaaaacataagaaaaaagaaaattatctgggaagtatcagagatagccagaaactgacatgtttgggaaagcctgaaggaggcttttctgaggctggaaagccagggcaggcttggagaggagggtcgggggcggggcagggcagggaggggagtgggatggaaactctgccttggctggcccaaggggtgccggaggtgtgtccctgccctgcctgtcaaaggctgggactttgagctggggctggagctgtgtgcctgtttcacctatgagaaaaagcaaaaccagggccctggtattgaaggccaaggcctgaagtggatgcgtttctgatggactgcatttgaatgactccatcttaacactgcacacagaattagtacaggcccatacaggcctgactgtgcctccccacccagtgtgtgtttgtaaacccacagacccctcttagtcacacaattaacccgtatctgccaccgggcaggagctgtggatttcatccctccgttgtacagcatgaatgcgtccccccgcttgccaggcactgtcctaggcgcagggccacagcctcgaacatgctcaacagaagctcctgccctcccagagctgatgttctggagagagttcagccttgactttgtaccgagatcccagaagtggttctgattttagttctgggctaaaaggagtgaaatgaggaggccaggaagtctttgcccctcgacgagggaacgttgtcaagtcccccactggttctttctgatgtctcccctgacccagatcagggcttgggcagccagaatgacctctttgctggggccaagaaagaggaggtatcagcattttccaaacaatcagagcacaccactgaagccaaaggaagagagtgctgagggcggagtttggggcacttagcctaggccagctgggaggcagcaacccacggcccccgacccagccccggagctttggggacctcaggctcagacgtctgccccccatcccaggcaacggccctgctcacaagccggtactccccgagtgccgttgccatgtccctgcttgtgccgtgccttctggaatgccctgcccagtgtagaagctgtaccctgtggcccgaggacgtctcttaggggcctcacacccagccatagcattgtcttgggtaccttgtccgtgctaccccacgtggtagatgtttttttgtcatttgctgaacaaacgtgcccaggaaccgagctcatgtgcatctgtctgtctcccggtgacacggggacatcctaagggcagggcccggctagaattcatgtcatcattgccaaagcccagaccagggcccaggccgggcaggagtaaatgtgccctgggcacctcgtaatgatgatcatcacgggcaacacgtgagtgtaagctctacctccagccaccctatctggcaggtatgttctgtacacggggaaactgaggcccagggctcaggcaaactgcccacagcctcacagcttcaagtggtggaggcaggatttgaacccaggtagttgggctgcgggaccttcgttctcagcagctgtagggaccccaagtcaagccgacactggcccagccctgtggggctcaggcgccgcccccgccaggacagcctcgggacgggccatgtggacacggcttctacatgagtagttgcaggggcagcaaaccctttccgcacaagatcagacagtaaatagtttgggctttgcaggccacatatttgtttttgttcttgctttttacaactctgaaaacgtacaatgtaaaaaccgtccttggtttgcaggccatacaaaaacaggctgtgggctggagttgactagcaagagggctgctgtttgccgacccctcaagtcgtgccccagctgagtttgttgggttggagcggggagcaggcagtggggaaggagaattccaggcagagagagctaagtggacaggaggctgctcgccagcgcacacagctcagggcttcacgcagaactcagagccctggcttttcttgaaaaatcagacctgggcttctgggcctgtgctcccctctggcgacagtcagatgggtatagccggtcacagtgcccactttagcctccccaggtcccccaggcgcttctgggctggcctcattcagggccatgcctgctggcccatcagtctacttctgcactaaggaatccaggttgctggaagggcctgcatgcattgaaggggatgggagggtggcagggcgctgtgaatgcaattagattcagcctccaggtgagaacagatgggcgggacaggggcaagatgagcaggtgaaaggcaccagggccttcaacggcagcgggcgggggcagacggtgcagcagagggttgggggggatggtggcaccagactccacacttttccttacagctcttgcacctcccagttgtgtgacccaggacacatctctctacctccgtgtgcctcatcttgaatcggcacagtaatgacagcacctgcctcgtagggtagcgtgaggtgtagtaagcaagttaatatattaacacacagtgcttggcacatgctaagtgctggagagacacagggaacagatctgacccatggcctggaaaggtcactttggcacagaataggccctaaagagtcactgggtcaatgggctggagcagctgtggacagaagggaagagaatccagtttacaggtggttgcagaatcccgtgaggggatccaggaggctggaactggggaagagcagaaggatcaacacgagagatttggacagtgattctatctacattcagcgtctgaccacaggcctggagttgagtgcacacgtggagcctctgcacacactgcactgattgagtctgggaaggtggtcaggggagacctccttgcgctggagcagacgggaaggaagagaagcctccagcagcaggaagggctggagaaaaggcattctaggcagaaggaacagtgagcgccaagtccctggggcagcagcccacaggggatactggagagagggctgagggagaggaggaccgatgggtaggccagggccagattgcagaggatgttcaaagactagtatcaggagcttgggtcttgtcttaaagacagtgggagccattgaagggttttaagtaggagagtaatatgatccaacttgccctttaaaaagattcctctagctgccatgtgggtggattttaggagcagacagaagcaggtaaccgtgagagtggtggctgtcggaggcatctcgctgggggatgatggtagctctgcccaaggttcaagcagtggcagtggagagaagcggcattggagatagcagaggtggggctcggtaacagctggatgcaagcagggagagggatgtctccagggtggatgggggtggcaggggagaggcgggtttaggggagcagatgagcagctggccgaggccctggcatgtctttcagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagagtaagtgtcacaacctggctgagtgggacaggaggagagagaccatgcctggggggccccattcattcactccgacagttccacagagactgtcactttgccaggtggtgatctaggggctggggacacagccacatctcctcacgagccacccattctagtggggagcagtagtaataaacagataaggccaggcgcaatggctcacgcctgtaatcccagtactttgggagtccgaggcaggcagatcacctgaggtcaggagctccagaccagcctggccaacatggtaaaaccccgtctaaaaatacaacaattagccagatgtggtggctcacgcttgtaatcccagctacttgggaggctgaggcatgagaatcgcttgaacccaggaggcagaggctgcagtgacccgagattgtgccactgcactccagcctgggcaacagagcgagatccatctcaaaaaaaaggaagaaacacacatacaaggttctgtattgattggctggtgaaaatgctaggaccagaggttcacaggaacccagctctgtgcttcccctaggagccatgtttcagcgttcaattagtcagtgtttgtggtgagtttatagaactaccctgggctgggcgcggtggctcacacctgtaatcccagcactttgagaggccgaggtggacagatcacttgaggtcaggagttcaagaccagcctggccaacatggtgaaaccccatctctactaaaaatacaaaaaattagttgggcgtgtggtgtggcagcagagtcgcttgaacccgggagcagaggttgcagatagctgagatcacgccattgtgctccagcctgggcgacagagtgagactcggtctcaaaaaaaataaaaaataaactaccctgaagaacaaaaatagactatagttgagtggggaaaagcctcactcagctgaagaagtgtctacaccttcacacctcattctcggcaagggccgaggagaggacagtcagacagaagccagggagcaggcgaagtggagagagggactcttctagacccagccagaaggctcagccgccaccctgggccatcgcttcaccattctgaggctcagctcccaccatcaaacaggaagaatggtccctgcatgactttaaaacaagaatgagcctgtgccctgaaaatgtgtggaggcgtcggggtccgccggctagaagtgtgccctccaaggctgggcagcttcccacgtagcccatttctctggcctaaggacagccaaagcctaatgagagattttaggtgttgtttttaaaaaaaattatggtgaaattcccataaaatttatcatcttaaccatttttaagtatccagtagtgtcaactatattcccactagtacgcaacctatctgctaaatgaactcttcatcttgcaaaactacaactgtccccattcaacgttatctccccattctcccaccccgctcccacccccaccccgttctcccaccccgctctcccaccctgctgtcaccccattctcccacccgttctcagcaaccactcttcttctctatgagcttgactgctttaggggcctcatgtaagtggaattgtacagtatttgtccttctgtggctggcttatttctcttcgcataatgttctccgggttcatccacatggtagcctgtgttggaatctccttcctgatcgggcacagtggctcacgcctgtaatcccagcatttcgggaggccaaggcaggcggattgcctgagctcagaagttcgagaccagtctggccaacaaggtgaaacccgtgtctactaaaaatacaaaaattagccaggcatggtggtgggcgcctgtagtccctgctactcaggaggctgaggcactagaatggcttgaacctgggagcgggaggttgcagtgaactgagatcatgccacttcactccagcctgggtgacagagcaagactgtctcaaaaaaaacaaaaagtctccattctttataagacggatgatattgtaccacagactagttagagattgaggtctctgacggcaggcgcagtgatctcctctggtccagccagccaggcagcaaatgtcttcatcgtggagcagataagtctctctccataacagcccagccactgcctgaaacaccgtttcccagctgatgaccctccgttacatttcctcaccagctgattaggaactactacattaacttttctagctgaacagaatgattggtttccagattggattacacagccagcatctccttgcttcaatatgtggcacagtcgataatctttaaataatacaagatctggcagggagaaattcagctcttttccccttattaatgcttagaggaaagaaaaatacctaaaagtagctgagagtcagctcagccctggtcagaatcctcatgtgagtgtaatgtcagagccgggacctgcacctctcaacagccctgtgagcagggcaggggtgatcatcaggggatgatggacaggaaagactgggtcacgtggctgatttggggactccagccccatctcctgcctggcattcttccccctgctagagtctccgacaagacactctgtccctcttttctgagcagtcagcctagagcaggctgaactgggggctttctgtcccccaggggacacttggcaatgtttggagacagttttggctgtcacaattgtgtgtgatggaggggtgctgctggcgtctagtgagcagaggctatggatgcggcaaaacatcttgcaacgcacaggacggcccccaccacagagtttgatctgaccccaaagtgtccgcagtggtaaggttgggaagccctggcccaccttgatccacggggatcctggctgtggcgtggggaggttaggcagagccagccagctcacagcagaagggggacccaggaacaggagaaggggacgaggactcgggggatgggcccagctgactggggttcattcatttcttgaactttgtgcaagacactgagattagagttgacctggagagacacggacttggacctcatggatgaaacaagatgtgaacaagtgaacaaagggccacttccgctggtgaaaaacgcatgaaggagacgcagcggtggcgggactagcagagaggggtggcggctccagaatggcgctcaatggacatttaatgagaacaaagtacagaaaggagcaggtcttgtgaccagccagagagcaagtgttctgaggaggaggaagatggagtacaaagaccctgtgctcagaatcagggcrgtgagtcccagtcacagagaggtgaccggtgtggccgagggtggtgagaagcaccatgggcatgggcagccacatcacacaggcggtcaccggcgtggagaggcagggagtgggcccagggttgtcaccttaggtgaggacgtcagctgcaggcagagtccccaccccctgcagtagctggtccacaccagctcatcaggcatgaatgcttcactagttccgtttcgtgccatcctccaaggagcctttgtagggtaggcaccatcctgagaagttacccaaatcgccggggccacacatgtgctcaggggtttgcacctgagccatctgattgcagagtcaaagctcttggccgccgggttatgaagtcctgtcccattccctgttggtgtggcaggaagggtacctccaggactctggacatgaacacagagtgatggggagagcaggtagtgtggcttcagtccaggaaaggattcacacagggctggcataccgcttctgtgaagagccagagagtaaaggtcttgggctttgcaactcagccctgcgactgcagaggtataagggaatgcgagcagctgtacccagtgaaactgtattcacaaagacagatggaggctggcctgggcccttaggccatggtttagggacccctgaatctagagctgggagatggagggtggaaagaggcaaagcagctcacttatgagccgactgagacaaaaggagtggagaggacacgctgggtctatttcctgagcctctcggggcaggacctgcttggcacagggaccatcctcggcaatttgtgtacttgcatcgggagactaaaccgagggagagaagtgcccaggagaaggctgccctgtgtcagaaaaggcccaaggctctgctggagaggggaggcctttcccggcccctcaggatccttcggcccttgtgactctgatgcaaggtgtctgagaactgaaagatacaaaacatcccccaagagtgggggtggcacccgggccacgtgagaagggagccctttcctccctccttccactgccttccgccaccacctgcctccagctggtcctctttggtcaccatctcggggtcacttgggatccaacaaaacctgggtcactaactggctccaggcccttctctttaaatgaggcacatctggagaaggatgacaactgcagtgcgtgcctgctggggccagacatgtgtcaggtgggcagaggttttaaaacaggaaggagtggcgggggctgtggccaacagggaagacagtgggcagccaaaggggccgcccatccccggcccgtcctgaccatatggaactgtgggccmgtgagacatctgtttcctttctggaagctggaaatctggatccctacatcaccgccaccacctcccctttttctttaatgttaccaactcagatttgtttttgagacatagaagatacaggctacctggggtgtcacttcagcctgcacccctgagttttcagcgtcagggcgtatgcaaaagcccccctcagccttgttgccggcccacctgggtgtagcacctgcctaccacctggtgggcagcctccagctctctgggactcaaagaagctaagtggcttccccagtccccgtccatttctacccagagacaggcactgcagggcccctttttcccagtttaaatcaacatttttacatccatgatactttttttcctttttaattgaggtgaagttcagataacatcaaactcaccatttttacaattatatacaatgcagaggcatttaataggttcacagtgttgcacacctctacctagttccaaaacatttcatcaccccaaaagggaaccccgtacccacaaagcagtcactcctcactaccctctcccccagcccctggcaatcaccaatcttctttctgccgctatagatttacctattctgggtagttcctataaatagaatgtaacaatacgagcccgctttgtgtctggctggtttcactcygcctgcttttgacattcatccacgctctagcgtgaatcagaacctcgctcctggttctggtcgcatattccgttgtacagatgatgtaccgccatttgtttacccgcaagcagctctcgcttgaaatcctcttgagtcagtggcttcttggctccaggacttccgtcttgccggtgtgatcacctcgaggccctcccctgcggtccaggatctgcgagcaggcgggtagattccacgacccctcgagtcgcaggcaaagctgagcctcatgcttggaagcccggccctatcttgatgaaggacccactgccctgggagcctggccagcctttcctgcctccctaactctgccactcctctaatgcccacagagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgagtgtccaggtggaagtcgagggtgaaggggacaggacagacctcggcaaagggcttcccacacctcttgggcccctgaggaccaagatgacaaggatggtggggacttcagtggcactggaggccttcccgactattcagccgccaaccccattaaagtgacacatcggtgagtgtccaggtggaagtcgagggtgaaggggacaggacagacctcggcaagggcttcccacacctcttgggcacctgggctgctccccctccaccacctccgagccacacgtgatcccttctctcaagcaggtgctacatcctagagaacgacacagtccagtgtgacctggacctgtacaagtccctgcaggcctggaaagaccacaagctgcacatcgaccacgaggtgagtggrrrssggrrrrgragcatgctctcggccaccacgggcctggcaggacccccggttcacagtgggagggcagtgaggccagacccagggaagaggctggagaggtgaagtgaggtccccacagattcctcaacgcggggataggtgtcagtcccagsatgagacagatagcttcctgcccaggccgtctgagrgacgatggcttagccacgttgtcccccttttgaytwacaagaagtctacgctacaggaggcctttcatcaaacccaggggagacactggaggcctcagtgggctcagcgggttcctgcgcaggccaggccggaaaaatgactcggttcccttgcaagggctggctggaggagaaggcgggcttccttcaggcagaacaagtacctcctccccacccagacatgccggtgcttgccctggggcccgggggrkksmrgsykscscksykswgmrcasasacrssrsmgygkgggsrgtcaccaggccaagtctttgttgtccagccttgaaggtttcaaggcctcctcttctgcccctccctcagattgaaaccctgcagaacaaaattaagaacctgagggaagtccgaggtcacctgaagaaaaagcggccagaagaatgtgactgtcacaaaatcaggtgaggcagtagcaaagggacctccctaagaccccactctcctacaggacagttcagttcatcccctctcgtgattgacccctttcattttttatttttatctttatcttctcccctcatggcattaaaaaaatccgtaatttacctccctgttgtcagccagtgtggcacacggacctgctcctcagccaggctggcgcccagattccagtactgctagcaagagacccgtgctggctgcgcagagccggctccaggccggaaaagtgcctctgccgattgccctttcagaaatcccccatgtggtttgaggtccatgttcccggcttaggggtcccctggcccaaaggactgaactctagaacagctctaatagaacattctgtgctgacggaaatgggctatatctgcactacaccacacgtggctggtgcatacttaaaattttggctagtgtcactaaggagccaaattttttattttgcttaattcaaattgaagtagccacctgtggccagtggctaccatactggacagcacagctgtagaagccctgctgtctttccagaaagtgttgcaaaacacaggcttccctgtgttgaccccgaccaagtgtgagtaggcagggtggtgagggaaccaacctcaagatgctgaggctttgacatgtaaaattaaccatcaaaaaagaaaggaaaaaggatgctgaggctgatgcacctaaagccaggcccagcttctagtcgtggctaaattacaattaacccaacctgctaaagtctagcaaaagtccaggcagagtcctggctcatgcttggagaaagaagccactcaggcaggcacctgctgccctgaggatagggtcatgccctacccaccaccaccccagaaggagggacaggggtggggcagcagcaacacatgggagtcccagaaatcacagcttgcacctgccagcggagccctctgagccactcctgaagcctggggctgggggggtctgttacagctaccacacccagcacaaaggccgcctcaagcacagaggctccagtctgcatcctttcaggtaagagcagcttgaggtcctggggaagagatgcagaggcctgcatgaggaggtggccctcccttaagctaaaactcagaagaaaaggaaagaagtccaggcccttccctgggaagtccacggtagccctcgaagaggccttacttcccaatcaacactgagcgggcctccgacgcccccttgtggctaaatggggttaccgcaactccaccaagcagggcaggacacaggaaggaggggaaaggggtgtcaacaggagtcccagtagctgcctggttctgtccccagcttgtgcccccttgggagttaaagtagaatgacaagacccaggttctggtcccggctctgccttggagcagcactgggacttgggaccctgaattgctatgcccatggctctctgttggagaagcctcagcgaagcccttaggtggacaggaagagcagagacatggggtcactgatccctcagaggcccaaggtgtgtgtggccctctgcgcccataggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacacgtgagcaagcccagggcaggggtggacaggctgaggcccaggggttcaagaaacttctccacttagtgacccagacctctctcagaaagggggtccccaacaccaggggtccacggtgctcgggacagcctcttggcatttgacgaactggttttaggggctgtccctgacaggaatcactgttggcagatggggcctcctcccgcaggcactcaggacatgctctctcttccttggcagtggggcctttctgtgcctgcaccagcgccaacaataacacgtactggtgcatgaggaccatcaatgagactcacaatttcctcttctgtgaatttgcaactggcttcctagagtactttgatctcaacacagacccctaccaggtacaggcaacccgagctagagggatgggggtgtggggtacaccagtgctgccaggtaggccccccccaacctcagggaagtgatgacaaattgtccaagtcccactgagtccctgagccggtgggagtaagttgtgaagctgctgagattgggggttctgtgttcaatcagccttttttgcctccatcaccctgctttttgcctccatcaccctgcgtgtgtaatatatatggcttcttccctctaacttaacatgcagcatgcaaccaggttttgccggaacttgtgaagactcctaacactgtcaggctgtaggatcaagccaaatatcacccactgcagggcctacacggaccgcgcagctaatataacagtaacacactgcaccaagcactctgctaagtgcttccgtacagtaagccatctaaacacacatgcgactgaagtggcccaggaccacacaagaccaaaaggagcagtggcatgtctggtcatcggaacatgtgggcccttgtacagggacagtcactactgagctccagcactagagctttcctgtactgtggccttggtattgcccaggctttgacctttcaagaaaagcctgaaataatttaaatgaaatctgatgtttaaatgtcagcagcacaaatgctttaattactatataggtgtgcagtctttctccttagataggttcaccctcatactttaccaaaggggtaggttaagtccctcaccggtagctcccagactacacaagaacccaggccacttacccgtcctttcatcaaatggctgctttgcaatcaggaggagctgagggcccctgaatgaaggctgctgataaaaccaagacttggaaggctttctttccaagcttgggaagtttcctgaccagtggctgcagaactccaacgttaaatacacagacgtggtttttattctcctgagttttcactctcatgaagagtgaacctggtgggacttgaagccaaaaagtcacctaactcttccaaacgctggctcttgcagaagttggagtaaacaggtcaccagcccctagcaccttccacccgccacctgcctgaaatatgtcccctggttggtagaagggcagggcgagagtccctgtacttaccttgttgacagactaccttttttgcaaccagctgatgaatgcagtgaacacactggacagggatgtcctcaaccagctacacgtacagctcatggagctgaggagctgcaagggttacaagcagtgtaacccccggactcgaaacatggacctgggtgagtaggcaccccaacgtggggcccttggacagcagggtaaccaaaggaagggactcaggaggtggtgtctaccccaagaatgagcctgaaatcaccaggctttgggaggtgatacagttccagacgagtcatgggagcccctgtccatagcaggcagatgacctttaacaagctgtgattcctgagagaggaacacctgcaccaactgcccaggaaacacacggaattccgtctcatttcattgtcctcccttttgtccactcatgcattcaacaaacacttcctgagaacttacacctgaaaccatgttgactaaagatgaccccatcctcgctgacttgtgtggagccagtgttgtcctaagaagagcagtccacagcaggaggcctcttgcttgtatggaaagggtaaaactggatggtagaatccagtgtgactggggaagggcactgctaaataaaaccagggtcagacctctgaactgagtcctgaaaagtaggatgcaatcgaccactgagaaaacgtggagggctggcgctccaggaagcttaaagtgtgaggagcagaaagcagctcagggggtgcagccaacacaactgaggccagtggagagtggcgggagggcatcgggccaccctgtgtggggcttcctaggccacggtagagtttagatttcatttgtggtgtatcaggaagccaatggagggttttaacctgggcaccgacatttgctaggtggagaatgggactttatgggagaaaacagcgaagatggcccagttatccagggagaaatggtggtggcttggactagaggtgggagcagtaaagatgatggatttcagattcaggtggtgaagcccccagacaacatggtgatgggaggtgcgggattaggagtcccaggtaaatcctgagttttgtttgggacaggacaaaatctgcagttttaagtttagaatgccaaccagatagatattttaagatgaaaaaagctaaacaggcatggttgctcatgcctatgattccagggctttggaaggctgaggtgggaggagacttgagcccaggagttcaaggttacagtgagctatgatagcaccactgcactccagcctgggagacagagctgtcgccccatctctaaaaataaaaaaaatatattaaaaaaagaaaacaaagctaaaagaaaaatgaagttcacttactagtgagagagagtggcctaaaaaaaacctttggtatttaaggtcccttggggaagggactgtgtctaggaggatgcctagagttcatgtcaggaaaatggctacacagcttaggaggaattcagacgctaccgtcggctctagttatgaagagggaagagctaatgtgtttacacaagatgttgcactaatacttctggtcaggagcctgatatgatcagaattttcactagtagcttcctaatctctgccactcaagtgctgctactcttgtgatcaaagtgcaatgacatattagtcactgtgtgccaggctctgtgctgagcattttacatgtgttagctgataagctttgaggtgaatcttatcctcattttatggaggagtaaggtgaacaaggtgggctgaccccggagcccacgcacttgatcctgccacatcctcgggaaaacttccccagagcccaaaggggaactccctcctgcacttggtcagggctcttggctttctgtcctctggagcacagatgttcatgcctgcatctacctccctcaccataactaaggtcagcgctgaatgaagccatcagggtcctgaaactgatcatggtgacactggattttaggcaatctacaaggctatctaggagacttagggcaggttcccctcataattcagtctacccctcataattcagtctactctgagtagggaacactatcagcatcatgggattgtgacaaaaaagcataagatggttttctggtgtgttggggttgttttgcctaaactatctgctcctgttttgtttttcatttctccttcatttaggacttaaagatggaggaagctatgagcaatacaggtatttcgttttattattaaagcctaaacaaagttctcctatcttggcccatccttcagtctcatctctgtgagtctgcacctgttatcttgagaaactgcccttccctctggtctgcccgagaccaggatcacccaccaaagataggtgtcacctaggagaccttctttgtatagttctttggggactttttctttcttggtgatggttaacattcattctcctttgacacttgaaaacttaggcagtttcagcgtcgaaagtggccagaaatgaagagaccttcttccaaatcactgtgagttgaggaaccagcttacaaatagaaatctggttctgaccgcttcattttgccaatgctattctatttgcatgccatttcttacataccaccctttgtttgttctcatgatgagggtgggggggaagtactaatgcacatctttccctaagaaaacacttgaatccatttcatgttttagattaatgccttgtccagtacactgctgttctcgctataatctgtgcttggtaaacttgagctattacttagaggttgagaagcatttaaatattacaaattgctaggcatcttgaaggctgtggctacaaaagtgctaactgatatacaacatcagtagtaggatggcctcattaaatggtttccaaaaagcccatgctacaaactctcactccagtgccattggaggctgacagggactaagagactggcaacctgtaaagttcacctctattctaaagggagcaggccagtttgctccctgcaggaatgggctgaggttcgccagattttctcattcgtctaccaaatccaaaaatgcaagtatgtgtgagaattctttatcattatcatctaatttgacattaagttaaccatgtgggcaaattatcgcccttggtgaactgccacttgcaacctctggtctactcatttcttcctttatatgcatataaacctgtgtggctttaataggacattagtaacaggtcacctaagcctttcttcggtgcttctagaattaaggtacagaatctttacatatcacaatctccttagccactattctgtccagatccttaaatgccatccttgccaggcattgggtgtataagtaaacaaaaaattgaggtgactaggtggtggcaatcccgttctaagtaacctagaaatattcattctcagcagccttgaagcaaagcttcctcagctataggaccgattaggaagtcatgataaagaccatgatagctaagtgctaagatgagtttgttttgttctttaggggacaactgtgggaaggctgggaaggttaagaaacaacagaggtggacctccaaaaacatagaggcatcacctgactgcacaggcaatgaaaaaccatgtgggtgatttccagcagacctgtgstattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaatccctcgcagttgtggacatttctgttcctgtccagataccatttctcctagtatttctttgttatgtcccagaactgatgttttttttttaaggtactgaaaagaaatgaagttgatgtatgtcccaagttttgatgaaactgtatttgtaaaaaaaattttgtagtttaastattgtcatacagtgttcaaaaccccagccaatgaccagcagttggtatgaagaacctttgacattttgtaaaaggccatttcttgggagttttttggtgtgtctgtttttttaaagtattcaagatactaccagtcaacatctttttggaagaaaatgccttgggtttagaagattttcttaaaaggggagtagatggttgtagattgactaaaaagtctaccatacttcaagggactacaggtaagtctcatagtataccagctttggtacttcattttttaaaaaagtattaatcaattgcaaagaaattcgccttggccaacccttctttgtgtatcaggtagtctaacctgatacaagtagttgacagatttcaactatcaatcaccagtccaacccatttctcatttaacagatgacggagataatccctaaaagcacccacatttgtttcaatgccccaaacaggccaaggctccctagcaactccctagtggcgttttttaacttctcagaaactgttaccattatttgaaataggcttccttaacctcctttacccttwacccaacagggayttaammmaamarrrawwyaaaaaaaaaaaaaaaaaaaaaaaactctttaggctccaattttaaatagaaacctttatttacaatgacatccaaaatggtcagcaaagcagtcacagctcaccatcccccataagtcatttcawrtggtttcaattctwwgcaagataaagaataatttctatttttttaagcaacataatgtaaacttgattgaaactgaattcattctcaagagtataagtcaattcctgagaatttaaatattgctctcatattttattcttcgaaactccatatattagaaaggaagagagaaaacaccctgctcgtttattaacagtgtgccttggagttgaaaacaataaatcaatccttgaggttttgctcctaggaacctaattgtgaacaaaactcacagcttctgcaaataaaaagggaactgggcaggcatacatgtaactggcaatccattctgtttactttcagctgcacccacctctggatcaaagaacttctaggacatcaagccaattatcttctgtaataccctacccctaatatagatacccccaactcacctcagatattaaatactgataactaagtagcactgttattgatatttacacctttcaatccagatgcagtttagaaaagtggcatcataatatgaacattaacaatgtaacttccgtttattttttaaaggaagaaacatgtatctcctttatatcattctgatctttataaaatatatatattttatttatatatctttggattcagcaaaaaaaaaaaaaaaaagtaggtactggaaatatcccacattctaaaagcagatgaaaagattatactgttcacccaacagataccaaggtttgaaaaaatggggggtgctggggtgtgaggagaggtagacagcaggagtacaaagaattacctaaaaaagataaagggcaatacaggtaaaaacaaattatctcaaagactgcacctattaaaagaaatcttgagtttgcaccaaatgaacaagtagaaaatataaaaacttataataaacttcatttttctactatataaaaaagggagtgctgccttccagttagcctggagccaggtctgaggaaaggattgcaaaaaaatttattttttttttgtttttaataatttttttaaagtcaagaaagataagagcaccattctatttctccccacacacataacttaaagaagggtcagatacaattgagctgaaaaagagacagactgacctggttcttcctctgtctccaaacaggagagtatactatctgaaaagcacaggccactacaatggaagttttcggatttacaatctttcttagatatattttgaacttggtaggggaaagagggcaaactcataattgtctatactgctttgaaaataagatccactctggtggtgggtctggaaataatcaggattcacttactcgtaagcatatcaaagatattaaatgatcttaccttcagagacatctagaaagattggctaaatgtgtgaaattcttaaaattaactggctctcagttattgctagaaaatgataccaaggctagcagagacctctgaaattcacagacattcagaaacccaattccgtcaactatttgaaccaaatgaattaacccagataaagggaattaaacttgatttttcccttcctcccaactgactaaaacaggtgtcaaagagaggcaacagcagaaaagtggtagggggcagaagagggaggggtttaaaaggtgctcagttagactgtggctctgaatcacagtaaaactggctgttctgggtactgagttacttaagaaataactgacactattctaatccacagggacataatgaaagcatcacattagtagaatgaggggacagctgagcagacaccagaaaccacaccaaggattctactcgagatctcaatatgggattcaggtcttagcaaccaaaatctgaaaacgctcctaaaggggatgaaaaggtaacataattaaacatacacacacacacacacacatacacacacacacacagcccatgaattgctattatttcggactgcttaaaatccaaaagattctcttcaaattgctcgtttttttaaattcctgatttttttttaagtttatttccccatatctattctttccccccaaattaacaaagtgcttagttctggtagaggaatttttaaaaaattaaaatgcctacatctaaacaaataatctctttaaaaagcatttagattaagagattgaaaagagcgaggcatctaaggctggggggtggggaaggaaaagctgtggagcactacccctcccccaggccacaaaagtcaagggatgtctcttccactggtagcctcaccacacagcttactgaaatcaacaatgttaaatatttagcttcacaaactctgtaaaaatgagttgttgtgacctacaaaaaaaggtatatacatattttacataatacaatatcttaaaggtcatatttacaaaaaaatctattcacagaaacactgcgagattctgattcagaatgcagtacctggccttgggttttcagaagtttatttttaaaaagcattattgctctaccatataggcaaagggtgacaccagtactttaaaaaaaaaaatcatagttcttgtctaacacgtaagtgtaggcaaaaaccaggaatgtgtttcactattccctcaagacctcaagaatattgcatttatccattctttttaaataaagtgcactcagctgcacattagcatgtgaaaagtttgctactgctgcgattaaatactgtcatctcatttcctttctgcaaagccatttggacatccatgacagttcctggaggtgaagtattacaggacatgaatggcaaatgaaaaccttcattaggagaaagcctagggcaaataatagggacagagcaactcaacaccattagtaaaggacaattcagaatcaccaattccactggacaaagggtcaacacagaactactacacctgaaggctgggactatgctctttgtccaatactgcaactagagaaaccagatattctaatctctcttgattcttccaatgttctctggcccacctacgtgtatttaagagattttggctagcaaggcagaaaaaagtgacacaaaagttttatgatcagtaacactccatgtctccagaattatatccctaggaggtggaatgccaaaaaacatttctgttttgaacaccatgatacacagcagaaggaggggggaaaaacacgtagatattgcccttcggcttaaaatccagtcctgctcaaatgacatcacttaaaatacccttgatggagctcaaagctggtcctttcttccaagatggatgcctggaacaatgattccttcccaataatcctagtgcagtgtcatttgtacagtggtttccttaagaggtcctggtgcagagatgtcagcagtatttctgtcagcaaccaggaaaaaaaaaaaaaaaaaaaaaatgagtaaaacacatgctttgcacaacaaaaaaatacccatgtccacattcatggcttacagtgcagctctggctgagtgattcaggttcctgagatcccatcttacaatgcagctctggcttaccaaaagtatctaatggcccaatgccttcaaaccaagttttttcaattactatattttaagttatacattcaagttaaaatatacctaggacattctgattatagcctaggctttagttctatccagagaacaagaaaaactttttgaaaaaggtaaggaatcgatcccatacctgatcaggacccataggcatgccagacatgggcatggggttcatgttcatctgtcccatgtgaccactgctgccattcatgtgcaccatactatacactgcaggattcccctggtgggcaaactgctgctgggaaaaggagctgtaagtaaacaaatggtaatattacctctggaagtcactttagcgacaaagggcatgcccacagaaattactacaattgtgtcaaacattgctatacttaagctgggaatgttagagaaaactccctgacagcctgtgatccatttttcacagctttctgtactagacaccctaatagatatgtgcgtgcttgaaggactctcaaaatggacaagccaaatcacaccttctaatatgaacccagtcctttcaacctctccatccaaaaaggcttgactgaaaaatacattaagttcttggacttctgggactaggatgtgactaactttataagtcactgttctttacctgttcctggccaaatttcctgatggccagcccttcatttctgaggactgatagatggatgcagcctgcgggtgttgcatcatgggattctgggagggacccattcttgacgacatcattgcattgggaggactagacactcgaccaaaggctggatctggttgttgtcccattccttacaaaaataaaacagaagaaataaaaatgcccaaatgccttctccttagaatatcagatttctgtagtaattttgttttttttttaaaggaggtgggggtggagggaagtgataagtgtaagatacagagtgctataagatgctgcccccccaggtattctagattctcaccaagatgacgactagagtaacaggcttactacagaaaggagcaccatctggatcactgaaagatcagttgctttaatgggtttcctgtagaaaagggactccgtatcactcaactcacatcactccatccttctttaaagggcaggggagttataatcctcagatgacagggctccccaatagacacctttattcccaccatgttcctggaacctctcaaaggctgaaatgaagaggtatctgcatcactgtaataataaatccagggccgggcacggtgactcacgcctgtaatcccagcactttgggaggccgatgcaggcagatcacgaggtcaggagatcgagaccatcctggctaacacagtgaaaccccgtctctattaaaaatttaaaaaaaaaaacagccgggggtggtggaatgcacctgtagtcccagctactcagggctgaggcaggagaatcacttgaacccgggaggcagaggttgcagtgagccaagatcgcaccactgcactccaacctgggtgacagagcaagacccccatctcaaaaaaaaaataataaatccaagtcaccaagaaaatcaacttaaaagcccacaaagtgcattcctctcactgacttgaccaagcattcagagattagagagttctactatactggaacatacaagaaggggcaaggggacaactttgcagtgtttcttccagagtttggggactcttaatgagtgggactgaaaaaaatattcaactatgacaggatacacctgtctcaattacctgtgtgctgcagcatttttgttttccaatcatttaaattaatttggttttccttgtgaagtaaagagggagtgaatcgtgtttttgtctttcatgtgcaataaatgtaatgaagcttatgtccttagtaatgttaacttggggaaggcacattttcattgtcagatttaccataatttggttgatatggaaactgttgcggaggagcttgtggcattgtgggtcctgccaaaagcccatccatgctgggggaagcagtcacattaggaggtgggctgaaggcctgggtttgctgctgttgctgctgttgctgttgctgttgctgttgctgctgctgctgctgctgctgctgctgttgctgctgctgctgctgctgcatcatcatagccaccctctgttgtcggaagtgatgacttagcagctctctgctgcgttgggcgaccatttgagcattaagaaaaccctgctaatacccaagaaagagtgcaattacatatatatagcaagaacctgccagttgcatacatatagtacccccacaatacaccaggtataagacagaaaacacccagggccttcttttttttaacagggtctcactctgtcgcccaggctggagcgcagtggcacaatctcgcctcacagcaaccttcgtctcccaggttcaagtgagtcttctgcctcagcctcccaagtagctgggattacaggcgtgcaccaccactctggctaatttttgtatttttagtagagatagtgcttcaccatgttagccaggctggtctcaaactcctaacctcaggtgatccgcccacctcggcctcccgaagtgcttaaattacaggtgtgagccactgtgccggccaaaacatacaattcttcacataaaagctttctgacctggtgcagtggcttacgcctgtaatcccagcactttgggaggccaaggtgggcggatcacttgaggtcaggagttcgagaccagcctggccaaaatggtgaaaccctgtctctactaaaaataccaaaactagccagccttggtgatgagcacctgtaatcccagctactcaggaggctgaggcaggaaaatcccttaaacccagggaattgacgctgcagtgagccgagatcgtgccactgtactccagcctgggcaacagtgactctcaaaaaaaaaaaaaaaaagctttctggctattgcaaggggagggagggagaactgaagaagagggacctgaaaattatttggggttaaaagacaaaagacaacacactgtcaagctttaacatgactagaaacattccacaaagtaagaaaacatttaggggtggaatctgaggacaaatttttcaggaactatgaaagacaattacaggaaaatgaggattcagtgtgttggggtggtggagggctgaaacatgaagccaaaaaaaataagatggggttatactcagataagcaggggtccacctcagaaaatcttgaactttctttaaactttcagaaagaggtaaggggcaagcagaagctatctggaggttcagaaggtgacataactgaagtacaacaaggaagctgatttcagctctactagctacgggtcatctccaaaaagcaagcttttatcatctttctgtaggacattctagctcagcttccacaagatgttttattatcaagaaaatgtaaatatcagtacttccaagtaggcataagacaataaaaatcgagcatttcacagttgctttttaaaaaacaattataaacgatatttcaaatcacartagaggattgctgtgtggtcatctgcctcatgcacattaaaaaaacccctcaatactgtctccaccactggctggaagtagaagggaattttaatatcccctcctactacaagaaacaggtcatctcagaggctatcactgagaacaggattatgtattctttattttcttctttataatttcagaattttacccagtgtgcatgttgtttcataatccaggaacagaggaacatttacagatttattaaattcctaaacagccaagtgatagctgttctcacagtacagcaactgatcacaaagggaaccaattaaaaaaacactaatcgatggttttaatgaagaaagctctccctcctctgattcctcccagtcaccagccagagagaagaatggaagagtcgaaagtctttaatgcgactgctttcttacacaagaaattcagaattaccttcatttgtttaacaaacatttactgagagccaaccacaggccaagccctgtcctgagcacagagcaatgcatgtggagaggcttatcatcctcacctgggagctcacctggggctgcatcataggcctcatcaccgcagcaccaccagcagtagggttttccattttcaattcaagtgcctgtcggctctgattcaaaaactgaggtgagacaagttggttagaatgcaagcagagcacgtcagtctgccaaaacagctttccagaccctcagcaccagccaatgaggtaatatctccaaacacaataacctggctaagtcacgtctaaactgaaccagtactttcacactgcaaaaaggtcaatgttgaaaagtctttggctagcatatgatgggctactgtttggcactggggaaaaaaaagtaaagtgcaattttgcagcttaaagaatatcttcacacctgtaatcccagcactttgagaggctgaggtgggcagatcacttgagcccaagagtctgagatcagtctgggcaacatgaagaaaccccatctctacaaaaaattagccaagagtggtggcacactcctgtagtcccagctacctgggaggctgaggtggaatgatcacctgagcctgggaggtcgaggctgcagtgggctgtgactgcaccactgcattccatcctgaaaccctgtatcagaaaaaataataataaataaataaattttatatatatatacacacacacaatagaaactcaaaagatttatagtcaggctttctctgggattattcgggcacatggggaaatacctttaagttgatcagaggaattctgaataaactccattagctttccctaaatgacttttagtgaagaaacggcagaaagtaaaatgaatacagtaacacagcttttctgagtacctaaactgacttttaacaatatttatgcaatggagtctctggctctttggattccaaactcaggcatttggccgcacacggtggctcacacctgtaatcccagcactttggaaggtcaaggcaggaggatcacctgaggtcaggagttcaagacgggcctggccaacatggtgaaaccctgtctctactaaaaatacaaaaactagccgggcttgcgtggctccccagctactcgggaggctgaggcatgagaatcacctgaacccagaaggtggaggttgcagtaagccaagatcatgccactgcactccagcctgggcgacagagcaagactccacctcaaaaaaaaaaaaacaaaacaaaacaaacaaacaaacaaaaaaaaaacctcaggcattcatctacttatatggtttgaagacataaacaataaaaacaattgaattttaaaacatttcttggggactaagaaaacaatagggtaaacagaagtcatattttagaatattaaaagacarctctagttttataaaacatctagaaagaagagttccattaaaaatgctgaaatcaagaaggtttaagtatttggttattagcagtaaggatttttttcaaaaaaaaccttatctacctttaagactacaaagtcatcaagtaacatttttcttccccaagagcaatccttcctgacatttttttactttttacctgtaaaatagaatattctcataaaactactccttaacaaggagccatttgtacaaataaaaccttacacagaagtaaaacaaaaagaatttctttagttgacagggatagattgcaccagtggtaagaacactgagaaacatagtctgaaaacaacagaaggagaagccagagggaagaacacatgactggttacctgctggccctgcagcctctgctgaagctgcattctaagttgcttgggggtgtttgtccggggtctcatgatgttggctcgtgggtgcattccttggagaggaaaattgccttgctggttcatctgattcatcatagagttaaaagatggtgattgtccctgaagatgaaagcctccttgcattggaggcccctgtgctgggtatgtctgtccatataatcctgccttctgatccatcattactgctgcttcttggccttggaaagcatcctgtttgggctctaatgcctgtcccttaaacacaacacataaaagaacagtgaagaacatctatgaaagcaacagaagtcaaatgctctaaagaaagtgcaaaaaacatccagtcattcaacaagtatttaagtaaatgcttgttatgtgccaggcatcacttctctacatgctaaggatacattcaaaataacatcccacaggtgacagaaaaagaagtaaaagttgatattctgaagaagagaacaacctgctgtgctaagacaagaaccaggtgtactgtgcattcacctttattttctcatccacaggcactgaatgccaagcatgcagccagcatgcttgacatgtctctcttgaagcatacttcaccccactgtacttcgcaacacttctcatttttctcccatctctctggcctttccttgaatgaatgctaactgttcatcagggttcagtcctaggctctcttattttctcttgatatattttctacttaggtgctctcatccrctggtgataatgatcacatttttgtctccagccaaaacatctctgaacttttggttttgtttatggaaatgcctacttaacatccgcaccctgatgtctcaggtatctcaaacttaacaggcagaaaacagacaccatgattcccaacagcccttccccccaagcaggcttgttctcctccaacctaccctactatatcacaatacagttggccctccatatccatggttccacactcatggattcaaccaacaggggactgaaaacattccaggggaaggaaacggtagctgtacctgactgaatacacacagtcatcattcttcttataataattccctaaacaatacagtgtaacaactatataatatacataacatttacattgtattaggtattataagtaatgtagagctgatttaaactatgtgggaggatgtgcataggctatatgcaaatactagactgttttatataagggacttgagcatccatggattttggtatccacaggggtcctgaaaccaacccctcacagatgtcaaatggtgacggtacacagcatcaccattcactgcccaggaaccaaaacccagcaatttgattcttcacattctcccyttccaagagtaaacacgtgtgaccaccaagtcctgtcaatttttcctccagggcatatcatgtatccctcccttctttccatttcacccttatgacccttcccaggacacctcttggactgttaccatagtaactggmaactatgtttctattttgtcccatcaacttgggttcatgtgatcctcccacctcagcctccccagtagctgggactacaggcacacaccatcatgcctggctgaagatgtcttaataaagcaaactatactttaagttaaacatggcagactgatcatgcatgcttacctgcattcacttgctaaccctactaaaatgacaataaagggaactaagaggtatccagtttatttaaaaaaaaaatacttaaaaggtagtatttatccataaaacactaataacgcaacaagatcaagtatttccatatttataatagaagatacaaagtgaatagagaagtaggaaccagctcaacagaacagaaaaacttagacttatgtgccyacagaggaaaaatacatatgaaaaacaagcaaatgtattccacagatctattgagactccagtgagggtggtaggggatcagagcatggtgctgamatgaggaggttggttaggagtctgagtatagagcaggaggtcaactacctccctgcctgctccctgactcccgaaaggcctgtaccttctacctacccgacaaaggtacaggggttcaggggcaccaagcagagcctaagaaaggagtgaggcagaggctgaaaacaggaaattttatatttagcatatttataatttaaataaaattttatattttataatttaatatcccacacttgcctccctagcccagctcccaaaatgcaaccaggtaataaaagattaccagatggcaggagtggtagtggtggttgaaaacaactctacatgtggaaatttggggagtcctggccaggcgcggtggctcacacctgtaatctcagcactttgggaggccgaggcaggtggatcacgaggtcaggagttcgagaccagcctggccaatatggtgaaaccccgtctttactaaaaatacaaaaaaaagccgggcgtggtggcgtgcgcctgtagtcccagctactcaggaggttgaggcaggagaatcgcttgaacacaggaggtggaggttgcagtgagccgagatcacgcttctgcactccagcctgggcgatagggagagactccgtctcaaaaataaataaataaaaatttggggagtcctgaaataaaagggctagggctagttccccacttaattaccctcagtaaagacaactgatgctgctcacacttgcaaagtgtcaaatcagcttcttaatgtctcactcttaacatataagaacagtcagggatcaccagatacttgataaaagcgtccaacactttccaagcttgaacgtgactcaagcaaatcaaagacaagaaaaatagagaagacttcaaaatatagaatgaagggccaggcgcggtggctcacgcctgtaatcccagcctgtaatcccactttgggaggctgaggtgggtggatcaygaggtcaggggatcgagaccatcctcgctaacacggtgaaaccccgtctctactaaaaatacaaaaaattagccaggtgtggtggcgggcacctgtagtcccagctactcgggaggctgaggcaggagaatggcttgaacccaggaggtggagcttgcagtgagccaagatcacgccactgcactccagcctgggcgacagagcgagactccgtctcaaaaaaaaaaaaaatagaacgaatttaatgcccaacatgtcaacagaaatcccagaaaagtaggtcagaaaaaaaaacacaggagagataaggttaataaagaaattatacaagaaaacacccctaaaccaaagggaatatcagtgtatctagtacacagcagaatgaatgaaaaaagacccataccaagatacagcatcataaaatttcggagagaaaaagttcctaaatcattccaaagagaataaacgggtcacatgcaaatgaatcaaaatcagaaagaaatacaactcagtggccacactagatgccagaaaactatggcagaaatctttcaaaagtatataattattttaaacctagaatgtaatacatagccagacatgtaggagggtggaataaagatattttcagacacatagaacccaaaacattttatttcatgcagtagggatgaagaagttaatagaagttgtgttgcagcaaaacaaaggagtaaatcaagacagaaagcgatttgagattcaggatactaggagtccaacacaggggaatagtgacaattattaatttctagacttgcctcacaaggacacagtaaaacagagagaactacaggagggaaggaaggaattgatgggttatttagtgtgcctgaacaagtaaagaaataaaaaagaacttctatacttctgttggagtataaaatatggctcctcagtgccaaggttctatgtcactggtatccctgaaggtgtacacaaggactgctcagcgtttcccatctgcactgtgacagcatttgccacatggcagtgtacttccatatgtacacatctatttccccaacaacaactgacagcccctgatgatctttcctgcttactgttgaacgcacaaacctatacagtggcccctccatagcctttaaataaaaacagtcatggctgggcacggtggctcacgcctgtaatcccagcactttgggaggccaaggcgagtggatcacttgaggtcagaagtttgagaccagcctggccaacatggcaaaatctcatctctactaaaaatacaaaagaaattacccgggcgtggtggcgggtgcctgtaatcacagctactcgcgaggctaaggcaggagaatcacttgaaccctggaggtggaggttgcagtgagatgaaattgtgccactgcactccagcctggttgacagagcgagactccgattcaaaaaagaaaaaacagtcactacagaatgtgtctttcagaaatacagatttgtgaatggcatgttttcataaggcggggtatgtaaacaggaacaggacaccatgatgttaggatgttcagcttggccattgtaaacaagttttgtttaaacaaacaagcaaaaaaaaagcttgcctcagaatacacacggcttggctaagtagtagagaaagatagttataaaaatgagaactgttaacatgaataaaaggtcacatttttaagaacagtacagtagcttaactaaatcatttctacaattgccaaaaatagtgggttgttgaaagtaatatcgcaatcgtaagtatattttctattttaacatacgaattgagaccaaaaaaggatattttccaaatttaatgctggtatccatgaatgtagtgatataacacaagtactaggagagacacacacaggcattcttgtatgtggcttcatgaatgtgtacgcgcgcacacacacaaatatacactctcctacttccatgttaatgcaacctacctgattgacaagttcaggaatgcccaaagctctgtcaatttcttccaggcctgtggcatctgtgttgctgagaagagtgtgcagctggtccaataatgctctttcgtcactctggccttccaggttggaaggtggcccaacaagatcatccagggaattcctaagaagaggcctagaaaaagacttgcaatcaatgtcaatggtgctttttttttttctaagagtaatagatcacagcaaccatgcatagtatttttaatgaacagtaactcaaatgctacaaacacaaataataaaccaagtggtaaaaaagagtgaatggcatcaatttaagtttaaggcccacaatttagaaatttcaccaggccactttagaccaccatatacagcttaaacccccaatcccaacaccaaattgtaattgccaaaccctaggcatttggggtatagcagaaatgggggccagggggagggtagggaaggatgggagaagatactcctcacaaaaacagtgaaggaggtaataattataatacttgaaaattagagaaatcaaaagaataaaaggaaggatacaaatgttgagctatggccaggcgcagtggctcaagcctgtaatcccagcactttgggaggccgaggcgggcggatcacgaggtcaggagatcgagaccatcctgtgaatggtgaaaccccgtctctactaaaaatacaaaaaatcagccaggcgtggtggtgagcgcctgtagccccagctagtcgggaggctgaggcgggaatggcatgaacccaggaggcggagcttgcagtgatccgagattgcgccactgcactccaggctgggagagagagcaagactttgtctcaaaaaaaaaaaaaaaaaaaaaaaaaaaagaagggagccaggcgtggtggctgacacctgtaatcccagaactttgggaggtagaggtgggcagattgcttgagcccaggagatccttgagccgagattgcaccactgcactccagcctgggcgacagagccagattccgtctcaaaaaaaaaaaaaaaaaaaaagaaatgttgagctatcactgacgtgagtctggagaaataccaaaatgactttgtcacacttggcccacagagctcatattggcaagtgtaacacaaaccccatacacccacagcaagttgcctcagttctccaacacatacaagggcatgaagttaaacatttatcctgcctcagaaaagttctgttaacttgaaactatttgctctctattgagtagagaagcattcaaataaattcatatagagtagagaagcactcaaataaattcatatagttacatcactgtctgctcaatagatcagttcatttttattttccttgcttaacttactgtagaattcctgttagagctgacattgaccatggcctcttgcatgcaagtaaattactaagctaaataaaaattaaatacaatctacaattttttttttttttagagacggagtctcactctgttgcccaggctggggtgcagtggcataatctcagctcactgcaagctccgccacccgggttcacgccattctccttcctcagcctcctgagtagctgggactacaggcacacaccaccacacccggctaatttttttttttttttttttttagtagagacaggggtttcaccttgttagccaggatagtctcgatctcctgaccttgtgatctgcccgcctcggcctcccaaagtgctgggattacaggcgtgagccaccacaccgggcctacaatctttattttatgaaaaattttaaagatgctatatagttatttcactatcatcactgaaatgtttaaaataattttagaaaacaattagccaatccttaaaagaattttctcaataggcagcaggtggttgggggaaaagaaaagtttttttaaaaaagtttaattttctggaaaactgaggctaaccctctgaagaacatttataaaaccactagaaacatgtacttatcttttttcccctcctcatgggactagagagacaatcatctcacagagaggctctcagaggtttggccactgaatggccctaatggctggacaacatggttgtatctcctccctctcctgtgaatgccacacgcactgcttactgcttcagcctcatttttacacagagttacacgagaaatgcccagctggcaacccagtacctcaattatagggaattctcattctctttcacgtttgcttctgtgctccaactcttttctaaactacccaatgctgagattttctacagagtcacaaaataacaccccacctattttgagtgccatgagaaacttgttccatggacaacatgccatcgggccaggaacccagttggttagatgctgctgcttggccatagggattagcccccattcccatggggatttcaccaggccctgggggagcaaaaagaaagcacaaattctcaaataagagcaaaaattatcctgaaacatctaactttcttttttcatgaagaggggagggtggacacttactcatttgaagcatctgctgctgctgttgcaatactggtctcgcacctggtatgctattagaccgaagaggcaatgtgggaatagagccacccagtgcaggtctgggtaaagaagtattataatctcctcctggtcttcccatggagtttgaattcataggttccattctgccggcctttgagtttggtaagccccagtctcctgaggaaggagtctgagtcacagtcacatttcggtttggcccacctaaaacaggtagccatacttaggtcttttccatattataatgaaatccttcttataccatgtaagtacagccattatacacaacatcaaccttgacaaaacagcactttgtcatggtaagaaaagggctggccaactgtggagacataggccactattctcatatattcaacaggctggaaaatgtcatagaccaaaagactcttgaagagtttacataaccaaaacatagaataaatgaaggatattcatggaagaaacatactaacgttattcaaaaagttattatttactcccaattatttagatggctttaagtattttaaatatgcttttcccaaaataatcatacatactaattagaaataacgtacccatacttgagccataattttcctgactatccatcattcttggattcccacccaacatgggttgctttggtaacatggggaaagcactgatattttttactggaggacttgagccaacagaaacagggctatccagagacactgctcggttatatggaggacgaatagactgcacagactgtgaacttttcaaacctgttgaaaacacaatacaaaaacatttcttcgtgatttaatatataaataatcaagtacaaaacacaaataccaccactccccacccaagaatgtctttcttacaaaaacaaacactgtcttcctttacaaaataagtgagggaagtggccctcacccaccaccgccaccccccgcccccctgccagccaaaaaagggtctcatattccaaataaagtagaaacaacaatctccatgtcggctgaagtactgagaacttttctgtagcctgatatggtcactgatactctgcgcttcacttaatattgaaaaattcacaaatgttccaagctcctgaaggttcttgcatatttgtacttaagtatactgtttataattttaacaatcaacttaaccagataagttgccttctgatcgaaaagaaataaaatgtaaaatccccttctaaccttctttttttcccccccactcttaattgatctatccattctagtttaggaaataatgctactgaataatgaccattctgaataattgtgcatgctgccttttcaattgacacacacaatatatctttgtttttctgtctgtttgtttgagacggagtctcactctgtcacccaggctggagtgcagtggcgcaatcttggctcactgcaaccttcgcctcccaggttcaagcgattctcatgccttagcctcccgagtagctgggaccacaggtgtgagccaccatgcccggcctacctttgttaaattgatgaagtcaacacacagcaacaggagaggggctagataagaaccagcaaacaccaaagaaaactatcttaattaaatgacaagattctgttaaaacaccaatggacaggttttaatctagagtctgagttgctttttaatccagttctctgtggctaagaaaaatatatgccctagtacctacagtactcacctggaataatcaaacatgaatatttttctataagtgccatgattactggcatattagttagaagtgggaaatttatttaatttttaaaaaacaggaaaatgttcaaaaagctttctaaagcacatataaattagtatagaaaacagaggcagaatatatgttctgaagttataaatgctatttatatcctggtcttagtgtaagagtgtttacaggtatgcagaaaagtttcaaaggcagcaaaaaaaaaaaaaacctagttcattcttacccagagaattagttccttgaaacacctgttgcttagtccccagatgactaccatttgaggatatggaattattgtaaaagtcagaactagtcagatcaccaagaatagcatctagattatccaagtctccagatccctgaaaataaagttttaaaaattaacctgtatacattaccagacacacaggtataaacatacccatcagaaaaaatgatacatgaaatagaagcaagtaaaatacaaaaactacctacaatgataatacccacctgaaaggccagtttattatgacccccatctctaatcttcctcctctgagattaaatcactacatttggtcctttcaaaggggcattttttaaatttacacaagacatttaattctcaaactgtagaatattttgcaggtaacagtcactagcagtgcattgataattagctaacagatatctgcatctacacaaaccttctgaaaataagtgtgattaataataaaaggagcaagctgggatgttcataggcatgctctaaaaagggcttcggtcaataaatttggtgaacagtaggttaagcccacatcctaactttaagcctttcattttctcaagtgcatattaatatatcctataagtttgggaaatgcttatacagaatgtcatcttgtgcatgaaacttgattttaccttaaaataaaaattatgctgcttaatacaagttttttttttcctgattacttctaccattctcttaatgacccaatctgcccattccagcaataaacacctccatgaaaaaatttcatattggctactaaagagttatagtcacatcttaaaacatacacatctgttatttctaaattacatcataattttactgacatccaaaataattataaagaaatgagagctaaagatttaactttctttaaataaacctaaaatggaagaatttttatatcacattatctaacaccgaaaaatgatgaaatatgagctgaaatatacagaaaacaaattacctcttcacttgtctctgtcttaattttagggtctttctcttgacttgagctaggaatggtggagctggtgcactgactcattttattatccactccttccacttggggctgtagttctttagagagtgcatcactaggatcatccctgtccagcaggtatctaagaagtgcattattctccttcttcttaggacttagctgctcctgcttgacaacatttccgtccccacaagaagttatactgctggtgtctttcccagtggcttctgcagtaatcttggctacctcagctggtgaattcccattctgcagcaacttgtgcaaaatccggtgcttctcttgtaacagtgacccatgcatattggatgtagaggatactcctccagatgtagaggaggagactccagaggggctggtgacactaacagaagattctttacaacttgaatctaggggggagttggtcaaggaggaatgaccccggtcatcagaagaacaggtaagtaactgcagtaattttttatgacctttgctttccaaaggacccctttgattctctgccccctcaacactgctctccttactttctttgtcactgaggtgatctctgctatttgactgacacattgaactctccactggattttggtcgcaataaaagcccagaggactcttggaatcctgattgcttactttacttggttgggtaatattcatattgggagagttatccaatttggggcctggtgatgacagagtagataaaagggaagtccccacaccttcactgatggcttgcagggcactgagagagctgctggaaaagctgtggttcccagtattgccagaagatgccatgggagagtgcacacctgaatttgaaaaaaaatttaggaaaagaattagactaccagacactgtaacaaaatacaacttaattcttcaaagtttctattataaaatagattaactttacaagaattatagtagtatggaaagaataattacttaaaaagaaaaaaaataaaaggaaatgtcaacacaaatacctgcaacaggagaaaactgatgtgaggctatctttggactcccacgattacgaggagaaatcatgatattctgctggtttggggcaagaccaggactcccatgtggggggctactcatgttgagcccatagttgttgttctggtaggaagatggtgattgcatgcctggcccaggggtcaatgaagctatgttactggaacccccatacctagctccactcatctgccctgtggtgctagggtctgccaagccataggccctgctgctcggcatctgtaagccttggtttggcgacatactcatgccgcctaccgaactgttgcatccagccataggtggtctaatcccttgtccaacaggatttgggtttggtctatatccattctgttctctgcaaaacaaacatcaaacttttactaaaaaattctaagcatgcatgaaagcttttaatcagatttaaaataaaataaaattttaaaaaaccagccagctacagtggctaacacctatattcccagcactttgggaagctgaggcaggaggatcacttgagctcaggagtttgaaaccaacctgggcaacacagcaagatcatgtctctacaaaaaatttaaaaattggccaggcatagtgacacacatctctagtcctagctattcaggaggctgcggtgggaggatcgcctgagcccaggagttcgaggttgcagtgagctgtgatggcactactgcacacctgcctgggtgacagatcaagactctgtctctgtttaaaaaaaaaaaaaaaaaaaaagaagaagagaagaagaagaaaggaagaagggagagagaaggagagggaataaaaaaatgggatgaattaactacccaggaacttaactttttaggcagcattccaatacctagtgacagttccaatctacatattgatcaattatttacctagtaacatatttttcagtaagccacagaatctatgagtgagaccactgtagtattatgaaagaccaacagctatgttaactggagtttcaggtgggctttattagagttgccacattatctagggcttcacctgggggtacctgcaaattactcaagataattaatgggtgaatatcctccccttcatgcatttcttatttgccactaccaacccagacagtaactacctttattcttgaagtttaccctcaaattttaaatgcagtccccaaagcaacacacattatcagaaatgagtggtaagacatgtaatcagattttatgtgctcttttatccacccattagccttcccatcacctagctttcctgtaaagtatttaataaataatcactttcacataaaaatacaaccttaaacatatcataatccaggaatctaaactcatttcatcaaacccaataaccttcctaaattttgtctcattttatcccttccctttttactttaataataaagcattttgagaacactgctgcattttgtattagaatacacagtaatctatcattacctctgaaggaagtgggttgagacaaagccatgtcgatcatttgttacaggatttcggaagagtttgctttttgtctgtgcagtcactatagttccatcagccaacgagaatcgatatactggggtttctgcatggccattaagataagctgttggggaaaatatcccatcactggtaactacagtcagcaaaacaaatatatataggaggggacagggaggaaatatacttcaagtacatttctaaaaatccaaggaaagactggatctgcaccaaaatcatcaacagggtaaaataagaacactcaggcatcattttcctacccctcaccaacaagagagcaactacagtcatgtgtataccaaacataatgacaaacaagatcaagaatcaaccacaaaaccaggtatggtggtgtgcacctgcagtcttggctactcagaagctgaggcagaagggtcaattaaatccaggagttcgagtccagcctgggcaagatagcaaggccctgtctctaaagaataaaatgataagaacaatcaaccccaaaattctttaccttcttgatagtgacgtttctgggaccatgactgcccatcatttagactaaaaaatctctgaatacaccttcggattatatcttcaaagccaggcctcatggaggatctcagtgaatttgtatctatattgacaacctttcctattaaacaaaaaaaggaaaaaaagacttatatccagcccacaagtatttactggctgcctacacatggcttagcactggagaataaaataaaagatattaaatctttgctccaccttctctgatccaaatttctactatatccacagcttttctccttaagacatagcaccacaggattctccctacatgttctgctaaggagtataataatacatttggtctttgtcagatttctagcacagagcccctatccaaaatcctcagaatttcctgagtaataaaagtattttcaagttattcataaagagcccctttggaacacacctcaatttatgctgatgaggagacttagggtggggtctctagatcacctcaggatggagctgataatcagaaagaccaagtaattaaaggattggaactttctgttagtagttccatctactaacctccaggaatggggcatgagggaggaaggagagcctggtgattaaattctataaaaaactcttggcctagcacggtgcctcacgcctgtaatcccaacactttgggaggccaaggcaggcagatcacgaggtcaagatatcaagaccatcctggccaacatggtgaaaccccatctctagtaaaaatacaaaaattagctgggcatgggagtgtgcgcctgtagtcccagctactcgggagggtgaggcaggagaatcgctggaacctggcaggcggaggttgcagtgagccgagatcatgccaccgcactccggcctggcaatagaatgagactccatctcaaaaaaaaaaaactcgggccagcaacagtggctcacatctgtaatcccagcactttgggaggccaaggcaagcagatcacaaggtcaagagttcgagaccagcctggtcaacatggtgaaaccccatctctattaagaatacaaaacttagctgggcgtggtggtgcgtacctgtaatcccagctacttgggaggctgaggcaggagaattgcttgaacccgggaggcagaggttacagtgagctgagatcgtgccactgcactccagcctaggcaacagagcaagactccatctccaattaaaaaaaaaaaaaaaaaaacctcttgaacaagagatttgatgagcttccaaaggatgagtacattaaggtgctgggaaggctataagcccagagagggcatggaacctccaaacctcatccccaccccctaataccttctcctatacatttctcccattgagatattcctgagttgtacccttcataagaaaccagtaaacctgagtaaagcatttccggatttcttgagccattctagcaaatcatcaaacctaaggagaggatcagaagcccaatttatagccagtcagtcagaagtacagaaggccaggacttgcaactggcatctgaagtaaagtacaggcagtcttgtgggactgaacccttaaccttgtaagatctaatgctaaacccaggtagaaactgtccaaactaaaattgtagggcacccagcttatgtcagacagagcgctggttagtgtagaaaaaaatacatctggggtcagaagtggtgtggcagtgtagaaaaacagtgttttcccaaatgctgtacagaatatatatcacacaaactccttttactgtctgaatgtactgaatatacatgtccagataaccttaagttcattttcgtgtaaagggaaaaaataacgcctatgaggaaagttgtttgtccgaagagattctgtccctacaactataagcaagagaaaatacctacttaaagtaagccagcagggacaattatttgcatctgagagatgatcacatttttgtacacttaatacctaaacttggagggttaaccaaatactcatttctacaatgctggaagcttctgacaacttttgcttaatatcaaatacaatggagacaccaaatatacatactcaaaaatactatgaaattaaagaaggtttcatgacaatagatggtccttaaaaactgtctaggccttttcactctaagcagcactagggtggttggcaaaagcaagtgccttacaaaaagtggcagaatgggagcaaagaagaaagtggttaatccatttcctaaaaaagactgatatgatgtgaaagcaccagctgtgtttaattggtaacaaactagtcaaaagggctcaaggaaccaaaactgcatctgatggcctcaagaactgtgtttttgaaatgaaccttgctgatctgcataatgatgaaactgcccttagaaaattcagactaattactgaggacatccaggtcaaaaactatgtgaccagcttccatggctggtcttggatcagctttcaggccttttctatgtctttgaatgcagacagaatgatccaagccataataactggtcacacagtttttgacctggacatcctcagtaatcttttctgtgacaaaatatgctccatggttaaacatggcagacttcataggaagctcctgctgatgtcaagattgccaatagttatctgttttgtataggttttactaagaaatgcaataatcagacttgggcaatctcttatgctcagcaccaacagatatgccaaatcccaatgatgatggaagttgtgacccaaaaggtacagacaaataacttgaaagaagtgggcaataaactgactccagacaaattaggaaagacattgaaaaggcttgcccaggccaggcgcggtggctcgtgcctgtaatcccaacactttgggaggccgaggtgggtggatcatgaggtcaggagttcgagaccatcctggctaacatggtgaaaccccatctctactaaaaatacaaaaaattagctgagtgtggtggcacatacctgtagtcccagcaactcgggaggctgaggcaggagaatggtttgaacccgggaggcagaggttgcagtgagccgagatctcgccactgcactccagcctgggcaacagagcgagactccgtctcaaaaaaaaaaaaaaaaaaaaaaagtcttgcccatatatttatcctttctatgacatattcattagaaaacatactgaagaaaaccaagtttggtttgggaaaactcatggggcttcatagtgaaaggtaattctgcaaaagctactggagatttaaaaggcactaatattgaataagctgacagaaataaaccaccagtccaataatctgtttaaaattcagaattttaatggtgaccaaaaatcttattagtagcagggggagactagggaaaagggataaacgcattctgggaaagagtaaatacctgtgcactcgtgcccaaaatagacatgatttgtcctcaaccacctctcctgagtttagccctgggccacatgacaaatacaaaacagatgtccataaaaagtttattaaatgaaacacatcagggacagaagataaaatatccccagaggtcaaaagtaagtaggatctcagttttaaatgatgttaatcacacaaagcatttgatctttcttgcttggcaatttttttctccatcatgtcctgttttctttcatgcttggtaatttctaacttttataataaacatgtatcacttttatatactgatgagataattttcaaagatgctacttgctaaattgcttaaagatattttatttagtatcttcagtagcaaatgtaaaacatggctattcaagtagaaaattaacactgccaaatcataagaggtgcagagaaagactcactctaaaaggataaaataatatataacaattgctgtcactatgtttatctgaggggagttaatacagagaaaatgttcaaatataaagtaacatacagccgggcatggtggctcatgcctgtaatcccaacactttgggaggccgaggcaggcggattacctgaggtcaggactttgagaccagcctgaccaacattgtgaaaccctgtctctactaaaaatgtaaaaaattagccaggcgtggtgatgggcgcctgtaatttcagctactcgggaggctgaggcaggagaatcacttgaacccaggaggcagaggttgcagtgagctgagatcatgccattgcactccagcctgggcacgacagagcaaaactccgtctcaaaaaaaaaaaaaagtaacatccatcagcgtaaacaagattatactgtgaattgtcaaaataatcctttgctacttttaattgtgaaaattaatctcaaaaatcctgaagataggttactgatggcataaaatgattgaatgactgcaaaaatagcaatatttctttaaaaatattctgcattatgtatattatatatacatattacaaacacacacatacatatgtaatagtgatagctatgttttatgtatacctactccatttttatatcacttgttaaaagtccacattgtaaaattagtgttacacaaagcaaagaatacaggctaagtcaggcagactcagctataaattttcttattagccatgatcttggacaataacccaatctctgtcaccaagcttctgtttctttatctctgagatggggcatatatgacaaacccttggcatccccatttacacttaggtgaccataagagtaaccctgaaggtaaataaaaataatattgccacagtgtttaatttcattaatgcatcttatcaaccacgatgtctttaattttttatttctatgattaaaaaatggcagaccaagattgaaactcaggttgacgtcaagaattactcccggccaagcacagtggctcacaactgtaatcccagcattttgggaggctgaggcaggcgactcacttgaggtcaagagttcgagaccagcctggacaacatggtgaaaccccatctctactaaaaatacaaaaattagccgggcatggtggcacgtgcctgtagtccaaactgtttgggaggccatggcaggaaaatcacttgaacccaagaagtggaggttgcagtgagccgagatcgcaccattgcactccagcctgggcaacagagcaagactccgtctcaacaaaaaaaaaaaaaaaaaggaattactcccaataattctcattaaattacttataattttttaaaacatgtttctttatgacaaatgggcttgaagttaaagaaatactaaattctgacgcaaaatgcaatttggagagaaaaccaggtgcccctaaattttttttttaatttatctgggggatttaaaatgccaaacatacccaattcaaatgccaagaattttagtgaaattcttttaaggttgcataagcaacatgaaaaaagatacacataaagcactcattacagtaggtatacatttctatgatagtacagattaaaaatagtaacatttacaaaaatttccaaaataaaaatgtacgtatacacagagagagagagagacaaaaaaagagtttttacctgaaagatcatgtctggtaataaagctctcagggtttgatggaaatgttctttctcctgtagtaatgcggcgtgccacacagatcatacaagattgcaaatctacaataaaaaattcaccctggtaaggattatacttaacttttggatatatatgttcaataggcaagcaaagacatggaattcagtaagaagggttacaacacaagtttcaaaactccaagtatggccactatttgtttcatgaacatcacaaacatataatagctcttaccttccccttcctccatcatagctcgtggctgagacagggcaaagcactgcattgtttcatatctctggcgcatttcaggactggcgtttatgtcttccagaatatcatgtggtgttttcatcaacatacggcaattaaatgtatggcttttttgtctttgggtctcatttgtccaggaaactccattaactttggaaaacaaattgaaatgacattttaaaaagctggtaactcattctatgaccatcatcaagaattcaagctgcattttctcattatgcatgttttccatagttatatctatactaacatttcaggctggcaatatacaaaacatgtgaataatttcaactttaacagaaatctcactgcatattttgtaactatatgcctcttaaaatgtataccaaatttttaattcactgactccatatgtgaaaattctgctattaaatcacatgcctttctaccctcatttgatcgcttgacttcctaaaagatacattcaattttctaagaaatggtcaaggaaaaaaatttaacctatttagaaaatacacattaaaagcctacctgtagattttggtaaattcttaagaaaatcctttctgtcttcttcatgtaagatattgtaaacacttgtgttaaccaggtcctcttgcttatattgcaggtattgtgtgacattttctgatacaaatacaatgtttccgtctcgattcaccacaaataggaaaccatccaatgcctaaaataggatatgttaatacaggctgttatggactgaattgtatcctcctccctctaattcttaaattgaaactctaaccatcagtgtaactgtatttggaaacaagaccttcaaggaggtaattaaagataaatgaggtcataacggtggggaccctaatccaatatgactggtatcctataaggggagagaaagacaccaggaatgtgcacgcagagaaaaaggccatgggagaacacagtgacaagccaaggagaagccaatcctgctgacaccttgatcctggacttccagccaccaacactgtaagaaataaatttatttggtttcacctaccaagtctgtggtattttgttatggtagtatcagcaaacagcaaccacagtagtaagtagaatgtgtaaaaactactgctgacttaattactgcaaacaactataagccaccattactactaacattagcaccattactacaggccttactggggggaaaaaaaaagaagaataattgggggtgggggagtgtgtacataaatatgttcagcatgaaatctgaattaatgtctaacctaatttttaaagaattatatctttaaaggagcttttaaaaatgagaaaagcatccttagctcttcccatttttccatttgatgccaagtcaagctacagaaactgctctactattccttaatgagaatttacaaagaggaatttcaaaactgatcaactaaaagtagttggaacaaactacctgaaacaaaaagaagttgacaagttaactttatgaagggcttcagcccctaaacaaatacaaagcacatgtttaagtcttaacaattcctcaagaatataaaaccatagcgtgccatgtgatcaatcacgcaaaaattcaccaaaaatgtctgagccgaaacgtacagtcatcataccccagtatctgtgtaaggttggttccaagacctcccaaagatagcaaaatctgaggatgctcaagtctccaatataaaatggtgtatttgcctatagcctatgcatatattccaatatactttaaatcatctctagattagttataatacctaatacaatgtaagtgctatatagtcatcacactgaggtgttttttattgttttaacattattttttatttcttcctcagcctccaaatctgtggtgcaaaacccatggatatgaagggccatttgtacccaaatatctctgtgaaattacaggctacctttcctttcctgcttgcttatatttttatgtttgtatatgtgtggttcctcagtttgcaactatatttttactaggggggcaaggcttcctgaattatgtatattgtaattataagagcattttaccatcatattcagaatactgaactgtctcaaagaaaaaaatgttttctttttgttctcatttcctaaccaaaatttcatcgattttttataactttataataaaccaaagggcaatacagcctactggacagttaaaatctttatacttgcctgaagtaaaagcggtcctaaggagtctttatcaataactccctgccctgtagaagatacatcggctttttgaacatcatcatcattggaaatagtttttcctgaaaagacagaaggtggtataacgaataacacactatcagttatagattaaatcaccttcgaatagtccccagaagagacataaagatacacatgcacatgcccatacatacatacaaaacatttcctcataagagaatgatgctacaatattataacatcaaaactaaacttcatagttgcccaggaagccagaagatacctaaatcatttcactactaaatgtactatcccacagcttcctgaaaaggaactaccaaataacaggcaattgtctgttaaccgtctctaaagagcataagctggaggcccagcgcggtggctcacacctgtaatcccagcactctgggaggctgaggcgggtggatcacctgaggtcaggagtttgagaccagcctggccaacatggcaaaaccccatctctactaaaaatacaaaacttagctgggcgtggtggcaggtgcctgtaatcctagctactcgggaggctgaggcaggagaatctcttgaacccaagaggtggaggttgtggtgagctgagatcacaccactgcactccagcccgagagacaaagcgagacaccatctcaaaataaataaatacataaataacaaaaagcacagctggtcaacacatttgtctattcccatacttgctagcctccatcagttgtagtctctacccaaacaaaggagcaaaaaggcaaatatagcaacaagttccttctaaaacaggggtccccaacccccagaccacagacaagtatcagtctgtggcctgttaggaatggggctgcacagcaggaggtcagcagtgggcaagtgagcaaagtttcatctgtattaacaacagcccctccccatcactcacattaccacctgagttctacatcctgtcagctcagaagtagcattagattctcacaggtgtgcaaatcttaatgtgaactccacatgcgaggaatctaggttgtgtgctccttatgattctctaatgcctaatgatctgtcacagtttctcccattacccccagatggatccatctagctgcaggaaaacaagctcagggctcctactgatttctatattatggtgagttgtataattatttcattatatgttacaatgtaaccataatagaaataaaatgcaccacaaacgtaatgtgcttgaatcatcctgaaaccatcccctctaccaggtccatggaaaaactggcttccacaaaaccagtccctggtgccaaaaaggttgggaaccaccactgttcaaaaagacatgagtgtttttattaccttgctcttttatttgacgtatctgtcttactgtttcctttaaaatcgcacatttatctggtttgacattgaaattgtcaatatcactaagattggcagatatcagctcagccaattcttcaatatatttactttcctgctcccgtctccgtttttcaccactgcaggtaagactaagggaaaaggcgtagaaaggggggaaaggagacataatatatatatcacaaaagagctgttagcagaatcagcccctatacaacactattacatgattacttttttttttttttcctcgagacagagttttcgctcttgttgcccaggctggagtacaacggtgcgactttggctcaatgcaacctccacctccaggattcaggcaattctcctgactcagcctccccagtagctgggattacaggcatgcgccaccacgcctggcttatttttgcatttttagttgagacgatgtttcaccatgttggtcaggctggtcttgaactcctgacctcaggtaatccacccaccctggcctcccagagtgctgggattacaggcatgagccaccacacccggcctattattttcatatgtaaacaaactaaactcagccaatataaactatcaaaaatgctgtcttggagaagtagtacaacataatagagattcatgtaaacctaaattcagttccatctttgttagctaggtggccttgggcagagttagcctcagttacttcatctagaaaatacgaataaatcatctttacttcttagagataataaaacaactaacaaataagaacaaaaacagtggtagctacttattaatgatgaagttttattcattgtagattgatatttttcaactagcacattaaacttcaattgacactgactttggcaaatactttaaaagctatagagtagtgttatatagattacattattttgtttctaatttttaagcttctcatttcacttggtaaaaaaaaggatgcaacctcacaaatgacaaaatatcaacttataacccattcttaaaagatagcaaagattcttacttataactgtcaggcctctgagaccaagcctgcacatatacatccagatggtctgaagcaactgaagatccacaaaagaagtgaaaatagccttaactgatgacattccaccattgtgatgtttctgccccaccctaacttgatcaatgtactttgtaatctcccccacccttaagaaggttctttgtaattctccctacccttgagaatgtactttgtgagatctaaccccgcccgcaaaacattgctcctaactcactgcctatcccaaaacctataagaactaatgataatcccaccaccctttgctgactctctttttggactcagcctgcctgtacccaggtgaaataaacagccttgttgctcacacaaagtctggtggtctcttcacacggacgcacgtgacataaccttggtcatctattcgtaactcctacccctccttccattcagaaattcttatagtaccgcgaattgttaatattctaccttctatatgaatcagcaataaaaaaaaaacttctattacatcaaaaagatgtccatctcatcagtaacactctacttaccacgaagtgaaaccaccaaaaaatctaaccagagaatgtaaatggcaagaagttaaaatgttatccttaaacaaaggcacaacaagtgtggtaaagcaccaggaaataagtcacctacccttgtcctggagtatcacatggcaatttgcgttttcgtgaatcactggccagtggatccaagttttctcctaatccactcatcttgaatatacatcagcaactaagagagaataatgagaaataagataagtacattaaaaaatatacatgactctatgaaggtgttatatgactgaatgactgcaacttttaattcagaactactttctctaaacagataattctcaatattctttttcataaatgactatactgaagacaacctcagatttcatattctaatatgaattatgcagaacgtatgtactccaagacagaaatgttcctcaagtcctactaaaaatgtgtatcttgcagggtgcggtagctcatgcctgtagtcccagcactttgggaggtcgaggcaggtggatcacctgaggtcaggagtttgagaccagcctgaccaacatggtgaaatcccgtctggccaacatggtgaaaccccgtctctactaaaaataaaaaattagccagccatggtggcaggtgcctgtaatcctagttatttgggaggctgaggcaggagaatcacttgaaccgaggggtagacgttgcagtgagccgagatggcaccactgcactccagcctgggtgacaagagctagactccgtctcaaaaaaaaaaaaaaaaatttgactgatggaaaaatagtatgctttggttaaaatttcattgatgaagaagataaatgtagagtacttcttgttgagaaagatgatttaagacatctactaagccctcatttgctaagaattttatctgtactaaactcttgtttaaaacaagacgatcactgttgtaaagaattacatgtcaaccaaagaagttcaacgattctaaactaatttttatatattaaaatgcatcttgcattccaactaaactctgagacgtatgctggaggacataaatttccactaggtggcagaatgctaccaggaaggaagacagatttataaaaatgaaaaaattcactcaagatgctgatcaaacttcaaatgtgtagctttaaaaaaaaaatcaaaagcaaaaaaacaaaaaaaataaaaatttaaaaaatcacatgatcataatataaatcagaaaatctagattgcaacattgtctttacagatgcactaaatatgtattaaattaccaagaaaattcattctataactttggttgtaaaatggaaaggctaaaaagctgagatgatttaagtatttgttttttccccatgacaagtttaaatgaaggacagaaaaagacttaaaataacctttattagtagtggctcactattattagtagtggcacagtcagatcacacaatctcaggggtattgtattttcaaacgtgtcaatgtcacaaaagacaaagaaagtctgtaaacagtccagattttaaaggaagctataagaaaatgacaactaaatgcaatatttgatcctagactgaatcctgtgctagagggtaagaaaatgctataaagaatattattggatcaactgacaaaattagaatatggacaatagacataaaagtatgttgtcaatattaatacacttaagttgataaatgaacgacggttatttaagagaccaatattcttagtataatatttggggtaacaggctattacatatgcaaattatcctcagatggttaagaaaaattgcatatataatgagtgagtgaataaacctgggaatggggacaggcagagcaaggatgaggaagggagttgacactaggtgaatcctgacccgggggggagataaacgtaaaaactctttgtactattttcttgcaaccttgctttaagtttaaaattatcctcaaataaaagagttttaaacttaaaggtatgttcggttttgattttccaattttcatatttaaaaagagtagctcaagtaatcccagtgctttgggaggctcaggcagtttgagtttgaggcacttgagtttgagaccaatctgtgcaacacagtaacaccctgtctctacaaaatttttttaaaaataagccaggcatcatggtgcacacctatagcattaactacttaggaataaaacaggaagactgcttgtttgaggagtttgaggctgcagtgagttatgatcacgccaatgcactccagactgggtgaccgagtgagactctgtctcttaaaaacaataataataataaattgaataattaaagagccaggtgcagtggctcacgcctgtaatcccaccactttgggaggccgaggcgggtgaatcacaaggtcaggagatcgagaccagcctggccaatatggtgaaaccctgtctctactaaaaatacaaaaattagctgggcgtggtggcaggcgcctgtagtcccagctacttgggaggctgaggcaggagaatcgcatgaacccggaaggcggaggttgcagtgagctgagatcccgccactgcactccaggcctgggtaacagagtgtgactccatctcaaaaaataaaaataaaaagaatagtgattccattccttaagtacaaaaatagaataattcttgttatgtctctataattggttttatatttgtttcattcaaaggtgatttttaaattgaatggcaaactatccattgagtaataacttttttttttttttttttttaaagacagggtcttactgtgtcacccaggctgaagtgcagtggcacaatctcagctcactgtaacctcggcttcccaggctcaagcaatcctcctgcctcagtatcccaagtagctgggacaacaggtgagcaccaccacacccagctaatttttgtattttttggagagacagggtctcactatgttgcccaggctggtcttgaactcctgggttcaagttatccgcctgcctcagcctcccaaagtgctgggattacaggcatgacccaccacacccagcctacatttctttattttaaatatgtaatttattccacattctagatattatttccttactttggcttttgtttataagctgaatccctgaaacaaatggagaaactattccatggataacagcacttctttaatttgaaagataaaattttgcctatattctcaatattatttcctttgttattaaatataagttgaatactcagtaaggagtaaggggcctaccatgtaataggtggtcaatatatgtcttgaataaatattgaataaatataaaagcaacattcaacctactaaatcatagtttagaaatttcctttattctgatctataacaatcattcaatgcaatcctactgcattaaactttttaaatgtttacttctacagttgatatagtgttacaataaattctgacagcataaattaaatcaatagaaaaactaagtcatgacaatctcttaatatgcaaaaaaattaataagcacaaatatcagtttaaaccagaaatgcagatcatttgtgttaagccaatgtttatgtgcatataatgaaacctaaatatgtcgagctatgtccatagacacatgcagctttttctcttgatctcacaaaacaagctacactgtacacataagcctgtgcaatcttcctgctaccaaacttactccttcagagtccaacctaattatccaaaaaggtactaagggaaggccgggtgtggtgcctcatgcatgtaatcccagcactttgggaggccaagatgggcgaatcacctgaggtcgggagttcgagaccagcctgaccaacatggagaaactccatctctactaaaaatacaaaattagccaaacgtggtggtgcatgtctgtaattccagctactcaggaggctgagacaggagaattgcttgaacctgggagatggaggttgcagtaagccaagattgggccattggcactccagcctaggcagcaagagtgaattctgtctataaaaaaaaaaaaaaaaaaaaaactaagggaaaataataacttaaaatcatgaaaaaggtgtttacccgaacataaaggtataattgtttaagatataaaatatttctatcttattttttgttttgttttgcttttgagacaagagtctcactctgtcacccaggctggagtgcagtggcatgatctcagttcactgcaacctccgcctcccgggttcaaatgattctcgtctcagcctcccgagtagctgagattataggtgtgtgccaccacgcctggctaatttttgtattttcaatagagacagggtttcaccatgatggccaggctggtctcgaactcctgacctcaactgatctgcccacgtcagcctcccaaagcgctgcaatcacaggcatgagccaccatgtccagtctctatcttgggttttttaggaacaggttggacagatttgtagttcttaattagacatggacaaaacttaggtacatttactgtacaactgtataagataccacaatgtctaagagtaaatgacaaattgttttataacaaaaagcaaagtagagcaaacatctcctgaatttcattaaactaaagaaaatgttcaacatgagaaataaaaaagcatttctggtccccaaaataataatttcaatatatacaataattcctgagcacaaatgactatgactaacccttcaggtacagttttctatttggtattaatcttagctataaacaaaaaatcaaaaatggcatttgttttagttgccacgcctgttatctccttctcactgggaggatatgctattttggtagattaagatataaaaggtaaatgcctagcacagacacaatagatctagatcactttcagtcaacagtcaagaatgaagatgagagaggggaataaggcaggtaccaagaccatgaagttcttaaccggtaagaaacatggaacagtaactacctgagactagcttacatttttacatcttaaattacaacccatctagtttggagaatatatgtagttgataaaagccatcttcaaagggcaaataatatagcacaacagtctcacactaagtttgattgtaagaacagtctaggccaggcgcggtggctcacgcctgtaatcccagcactttgggaggccgaggcgggtggatcacctgaggtcaggagttcaagaccagcctggccaacatggtgaaaccctatctctactaaaaatacaaaaattagctgggcatggtggcatgcacatgtagtcccagctactcaggaagctgaggcaggagaaaagcttaaacccgagaggcagaagttgccagtgagccaagaccgcgccactgcactccagcctggatgacagagtgagactccgtctaaaaaagaaaaaaaagaacagtctattaacatagagtcccttcttaattctgactccctacaattagatattatcacttatagttgaatagaaaagaaattaggacctatacttgctaccaagtaatctgtcctcctgaagttacatcatacatccaattgtgagatgcatccatattttgaagtttccactgcacctctaatgcacttccaagaagatacacaatccagtctcagaagccttttcaagcccctggcaccaaagtacagaaaagaactggaaggaagaacttctcattttatcagaattcaaaggctaaaaccaagtcaatctttcaatataaactctatcatccagatccatgagccatttttacaattattttccttatctaaaatgtttccactaaaaaaagttgtatgctacactacttaaatgtattaaatatggcaatgcacactttaagactgcatttttaaaaggctgggcggggtggctcacgcctgtaatcctagcactttgggaggccgaggtgggcggatcacctgaggtcaggagttcgagaccagcctgaccaacatggtgaaaccccatctctactaaaagtacaaaattagccgggcgtggtgacacatgcctgtaatcccagctacttgggggactgaggcaggaggattgcttgaacccaggaggtggaggttgcagtgagccgggattgtgccattgtactccagcctgggcaacaagaatgaaactccgtccaaaaaaaaaaacctgcatttaagcaatatattccatgcaattacttttttttggcggggcggggggtgggggcggggggcgggtggagtgcagtggtgcaatctcggctcactgcaacctccacctcccagattcaagcaattctcctgcctcagcctcctgagtagctgggactacaggcgcctgccaccaccctggcctagtttttctatttttagtagagatggggtttcaccatattggtcaggctggtctcaaacacctgacctcaagtgatccacccgcctcagcctcccaaagagctggaattacaggcgtgagccaccacgtctcgtcacaattactttaatgtagaatagtaacaatgagaatacctttcaatgctatcaaaatctaacgctatttctatattatatggaaaagtccaaagtatatccatgataagatttaaaatgaacaagtatcttacaacaactggatagaatgtttcctataaatactataggcctttctatacgtaacattcaagctatggaacatgttgaagcttagacatcaacagaatatataataaattgttagaaaatgaactttcatggaataactaactaattaaagctgaaaagcagcaaagaattatacctgctagctcaaaaaccatgaaaattttggtatatggcttagcagcactaatcagctttccttttggttatttgggattaagacaggagggaaaaagtttgattatacacagcaaattagctaaatggacaaggatacaggaactacgccctgtccaaaaggaaaagatatcaatcaacactaccagtgttcattaggcaagcaagaagttattttgagggacctaaaaaaagctatagtgtgccaaaatagcagatgggttatccagtaaatctaaattgacatagaaaccaactaaaatattttacttttcctaaattaataagggagaaataaggagataattttgtggtagtacaatactagacatctcatatatactgtaatttatttaccatgaccctccagagtatgtattactataatagtcccattttacagataaggaaatggctaactttccactagagcacacacagattctggatggcagagctggaactacaatattttttcagacttcataaccaacaaaatatgtatcaaatgtttcttgggcattttattccccaccaccaccaaaacaagccatttgtactactgaatcacactatagccaaccagttagccagaaaatttctcagcttatcagtaagaacactgagaggttatgacagccatagtttaggggcatgcagtattagggacagaggcaaggagttgctcaagctcagcagatactaatgctcccctcaagtaccttacctaaccattacccaccgatgtcactaaactgcccttcgtggtggtctaatattacccataacccttacttccacttgagatggtcaatggctcacacagcaaaaggaaaatttgagatcgacatatacaaactataccttaaaatggtcagtcaagtattgttattctttggtttgctatcattaaatggtggagccacttgactatcccagcagcaatttagtttatctgtcaggcttgtttccctaacttatacaaggtatgattaaatacactaattagagagaggtttggtgtatttcttgagaatcacagtaacttatggaaattttttcaaagagctatggatctgaactggtttattaaaaactgcttcaagcactatgcaaaagcagagactgctcaagtcaatcagaaaaaacaagttcttgggaagaatgagacagtcatacataaaagttctacccaaaactgaaattccaaattctcaaattcctaatcagacaacttagaaaataaccactactagttaacacaagggcttaatcttacaaggtttttttctctaccctaaaaatatcaaaaagtttcttaatcttctttctttcaatccgtcattcatacccttactaataaaataagaggagctccaagagaactggtaccacggagaaaggactgaagacaaatataacgtgtgtaaaggacaggggaaggcagggaagagcttttataacgtggaactgttataaaagcttcctcctcaagtggatgactcttccagttagtatctcctcctacctttgtttctttcaatgctggtaaggaagttaagagctgtgaggagataagtaggaggggaaagaaaagaaaattttttttaatttttttttttttttaagacagagtcttgctctgtcgcccaggctagagtgcagtagcgcaatctcagtgcaacctccgcctcccaggttcaagcgattctcctgcctcagcctcccgagtagctgggattacaggcacccaccaccacgcccagctaatttttatatttttagtagagacggggtttcaccatcttggaaaggctggtcttgaactcctgacctcatgatccaccggcctcagcctcccaaagtgctgggattacaggcgtgagccgccgcgcctggcctacttatttatttttcttttgcttcctcatcctctgtcagagagggaaattttttatatccttttgttttgtggctgataatttgctattatgttttgtaggataaagtataacacaatcctttttttttttttcaatttaattccatttcagctcaaacgttttgcatgcccagaatcattttagccccagaaaacagggataaatgtcactaccaattactagaactctcaggctagcagaacaggaaaacagaaaaacaattaaatttggtaagtgttaaaaaaaaaaaaaaagaaggaatcgtttgaacacaatgaatagcaaagctaggagcctacagtttttagaaacaaaacatacacatggtatctacaagaaactaccttggtggagatgtatacaagaaaacagtacaacttcagttcttggtaatttcttctccactatctttgctttataatgccagcatattgagtgaagggctagcaagaaacaataaagtaaaacatcctatttttaatatataaattgaacagaaaagcatctgaatgtaaattattttatgcgcaaggttccattctctcttccttcttgcacatttatgttccagtttaaacctgatgaagttgaatttaaacataaactccccagagactagagtgctagaactgggcataccaattagccaactcaggtgttagttgcaactggaaacttgctgccaagagacttctcaacctctacatgagcaacagagttgaagttcacagataatacactgtacagagggagttaagggagccaattccatccatatccaaatcaagttaccctctcctgacagcatactaactagccgggtaactcttttgttttaaaggttacattgacttctacaatttaatacactgaatctatctcatatataagaacagacttaagtctgagcttcataaacctgaatttggcttcagtttaaacaacctgttaccagtcatacttcttcctcatcaatcaccaccagcaaccccaaaatgatctttatactaaaagtttttaataaaggtaactgaaacatttcctttatttttaaccttaagtcactaatttttttttaatctttcccacatcgcttttccatctagaatattcctgcccttcaagattaatttgtcacctctggtaaaaccatccccgactctcccaattagacaaaagttttcccttctttatcctaagcattttccatatttttactataacattttacatattacactatttctgtctctgcttcctaccttgtaagctctaaaccattgtgtaaacttgtatgtaactctattttttacaaattttttttttaactaccaccattcctcttctcttttcaaactccagttctcctttgctttcccatcagctgtacttttgaccaactccacatcttcttaaaatacagagaaggttctccttttacagaggtaaaaagaaataatttggctgggtgtggtggctcacacttgtaatctcaacactttgggaggccaagatgagaggacagcttgaacccgggacttcaagaccagcctgggcaaagtggcaaaacgccgtctctacaaaaaatacaaaacacttagccaagcgtggtgacgcacacctgtagtcgcagctactcgggaggctgaggtgggggtatcacctgagcccaggaggcagaggttacagtgagctaaggttcgcgccactgcactccagcctgggtgaagggagtgagaccctggtctggaggggcagaaggagtggggcttttttattttgttttgttttgtttttgagatggagtctcgctctgtcacccaggctggagtgcagtggcgcaatctcggcttactaaaacttccgcctcccagattcaagcgattctcctgcctcagcctcccaagtagccgggattacaggcagctgccaccatacccacctcatttctgtattattagtagagtcggggtttcgccatgttggccaggctggtctcgaactcctgacctcaggtgaccaacctaccccagcctcccaaagtcctgggattacaggcatgagcccggccgaggaggagattttttaaaccccagtattgtgtaccattttttacctctggggtttgtagtttaattttcctttgacagacataagtatctctacatcaaaagtagtacttatacctaagtttgtccctgtggcatataatgaaaataaaaacagcagaggaagaaagagataaataaaaaccaagggttttagccatgctaaggtaagtgagaaagaactggataaagaagagtggtgaggagggacagtgggtatgtgcacagagcagaaatgaaatctgatataaattaaattaataagcaataaagatgtaaaggagagatgatcacagcatatgccccattctcttctaatctattctttccatctacctcacagaggaaaagacagtattgagaagtaaatgttaaagcttaagagatgacaacattagccacctggtaaccaaacagctgagagcagcaaggatggtacataaagtgtaccatggtacactaagtaaacaatgaagagggggaatggtaaccatggtcaaatgcaagacagataaatattcctaaaccagagtgcctgtagagtaaaaaacaaaataacaaacttcccactatagtactaaagttagccctgtccagcaatatcaaaaatagaggctacaatgagtttgttcacctgcaacactgatgttacaaaaattaagactgtagaaataaatgtaaagctaataaaagacttttgggttgatttttcaaagaaaagatattgaaggtagaacagagagatgtccttcttataaagcaaagaggttggagcagatctgtaactctagcaacacgacacggcaagtctgactcacaagacttcctgaataggtcatcatctgtactgctgcttagtctgtggctcagtcctttttttcctgacctcacagcttattactcttcagtaatcattaaataactttaaattcaaaagaatccttttttaaaaatgtttccgggccagtttcagtagctcacacctgtaatcccaacgctttgggaggctggggcaagaggattgcttgagcccagcagtttgagaccagcctgggcaacatagtgagattctgtctctgcaaaaaacacaaaaattagctgggcatggcagcatgtgcctgtggtcccagctatttaggaagctcaggtaagaggatcacttgagcccaggaggtcaagtctgcagtgaaccatgatcaccgcactctggcctgggggacagagcaagatcccgtctcaaaacagtaacaataataatagtttccatatccctagaagttatgtgtctgataatagaatttgtcttttcaaataaatctctaaagccattattcatctgatgacaacaatacaaataatgaataagaaaatatatatcaaaaagttaaaaaataaaaaaagctttcaacattatttgctttctggagggtggggtagcactggtaaaaaggttaaaaggtatcagaactgaaaactcaataaaacccttgaccctctccattcctctccaaaaaatagctaccgtcttatgtggagctaaacatttataccattaggtcaagattgcttcagggaagaaatgtgcagtaagcaaaaatataaaatactgcaaagaggaggagaagtacatcattcaatttaaaatacaacattaaaaaataaaaataaaaaataaaatacaacatagcttggttttttctttgttgctattcaaatgttagtttcatgatccataactttttttttttttttgagacggagtctcgccctgtcacccgggctggagtgcagtggtgcaatctcggctcaccacaatctctgcctcccgagttcaaggaattcccctgcctcggcctcctgagtagctgggactacaggtgtgcaccaccacaaccagctaatttttttgtattttagtagagatggggtttcaccatgttggccaggatggtctcaaactcctgacctcgtgacatgatccataactttaaagaactttttttctgtacttcacaaaacctgcctatccatgtctagtaaatgaagctgggggcacctcattattattagagaatatctgaggcaagaaaattttattacgaacttctgtaaaatcatccatacacctaaactggttaaaaccaaaacctacttcaccaagtatcttaagagtggtcactgttcaacatatcgggtgtcatccacatagaaaaaggaaatagtatcccctatgctaagtgcttggggtagatgaattgttgatcaaaacaggaatttttttgccttcaaggagctgatgactcggtgtgaggaattaacaaactagtaagtagatcatcagaaattgtattatatgctacaaaacgtctttatttaaaattaatggccgatttgtgattcagaaacagaaacaactgagtaccagacatatcctataatgttatacagctgttcaaagtcctaaatctctatagtagatatgtttcttactaataaaagaagtagattcaggttaacaactaaatgcccctgaaattggccaaacttcagattggttagctcagacctcctccgtatttaagcagcacagaatagaggcagctgtagcaggaactgggtgtgctacaagataccaaatacaacaaggtgaaaggtttaagtcaaatgcttctagagttccaaccaaattcactagatttcaagccttttgatctcaggattcctttacctcttaaaaactggaaacctgtaataacttctgctatgtgggttatgtcagtattcaccatattagaaattaaaacttaagaaacattcaccttttttttttttttttttttggagacagggtctcagctctgtcacccaggctggagtgcaatggtgtgatcacggctcactgtagcctcgatctgctggtctgaagtgatcctcccacctcagcctcccgagtagctggaaccacacgcatgtgccaccatgcccagctgatttttttaatttttagtacagaccaggtcttgctatgtttcccaggctggtctccaactcctaggctcaagcaattctcccacctcggcctcacaaagtgttggaattacaggcatgagccaccaagccggactcattcacttttttggtttatttgttttgttttgttttttgagatggagttttgctcttgtcacccaggctgggctggagtgcaatgccgcaatcttgactcactgcaacctccacctccccagttcgagcgattctcctgccccagcctcccaagtagttgggattacaggtgcccgccaccatgcccggctaatttttgtatttttagtagagacagggtttcaccatgttggccaggctagtctcaaactcctgacctcaggtgatatacctgcctggcctcctaaagtgctgggattacaggcatgagccactatacctggccctcattcactttttaaagcccatcatatattaacataaataacaatttttgcaaaaaacaaaacttctgaaacaatgagaattataaaataattaaaaacatatatttgcatataattacctgacttaatagaaaacagttatttacttctgcattcaatccggtgcaatgttatcttgatttaaggatataaagaaaatctggcctcacaaagacatgtacttgtaaaaggaaggactattttaataaacttttataaataattatggatatttcttgatattacactaaaacaactggtaatttcttaaaggtgagttttataggagagaaaaaaataatttttcctctaccctatctgagttctaagttgggtcagaccccttaacaaaagacaaattaacaagagaaaatcagaaatataataaatatatctcatgtatccatgagagatacccagagaaatgagtaaatcttttcatttctaagaggtggcttagaattcagacttaaatatcatcttcagctgaaacaaataaagaagggcacaggggctagggagcaatagttatggagaggtgaccaagaaaagcatggtaaacaacagtaaggcttgttatacagatttaagtctatgccttctccattagtaagtttctagtgattgagtcatccttttcctggtaatgaggaagacacccttacaagggagatttcctttatagatataaattttcccttacaaaagggtaacttctactctgttttcagaacttctcctgtgtctgcttctcaaaataatccttacaccaaacaggcatattttagggtggtatattctagtctcctacagttgcaaagtggaatctgaaaccatataaatgaattttcatgctgtctcattaaaatgcattggatctaacttgcactctgaacagatctttaacccatgcatcactgtataatcaaacaccgggtcatttagataatactggttcactgagttaaagtagatctttcaaatgctggtacatttcattacacaatttttttaacccacattcattaatgtcaccacccatctcatcaggaaagtaataaaaggctgttatgctcatggtggccgattcaagtttacttacttataatttcacttgaagctcaaattttatcactgtcaaccaatacagtcagatgttttccctgtagtgacaggttcacctcactcaatttgaagacagtctccaaataaccaagactcaatagccatggtttgtcactcatccaagtaaaaatggtgttccatgaaaaaagtgggtacttcagttcacaacgcaaactgcgcaagtgcttttcccggagacagccatcatactttggcaggcagaagtctttgtgcacattttccattctcatcacacagaacattaaaacgacagtacttaagggtacagtgaaaggtacttaaggaaaaaagggaatgagggccaggtgtagtgttgctgcttcatcatggacaatcctcagtggaaaactgatttttttttttctttatgagctcctggcagtgaagaatgcaatgtctacctaggagcggagtctggcgccactgccttaattcatggtaaggtgtcagcaattttatgcatcaccgcatttccaccatcggtgcaaacaccaacgggatgaaaatagcaaataacacattagcattattatgagaatagtcttaaccatgtagaacccttaaaaggttctcagagactaccgggagtccacgcaccacacgttgagagccactatattagattaaggttggggctgagagcctgaaactgggtctggcttctccaagataccccacgttcatgtaataaatgttttagggccaggagcagtggctcatgcctataatcccaatactttgggaggctacagtagagggtcacttgccagaagttcaagaccagcctgggcaatgtggcaggacactgtctctacaaaatacaaaaaaattagtcaggggtggtggtaagtaaataaagcaagtaagcagataagtaagtaaataaacagatgctttagtatctactatctgcaggcctatataaacaagccatgttgtgagatcaaaagaacatggagacttcctgaaaggataacagagaaatgctgctatcaatcaacaccaccttatcccattgctccaaatataataatgacagataaaatacgaattttgtattaacttcaaaagacacagttacgctcaaacatgacaaatatatttgtggaccatgacagaggggaaatataaagcaataaattaataactccatgaacccaactgagctccaggacaagaaacaagcaaaggcagtcaggaaatgaaatcatgcacaagataagaaaaccaaaagcaaggctcacaggtaaaacgaaaaaatctcataggtagaaaccaaacaaaaaactcatgaaaggaaggtgaaaaaaggtattatcaatagctaaagttattatttcaaactgccacaggcagttgtagaggaaataaaaggtactctaaataaataaaaggtaatatatacataataataatatatatatgtctcatacacacacacacacaaacaaaacctaagtaatgcatatcaccaacattgcaataatatctcagaattagaatcctagatctagactgaaagcatggtgtaaatgtatgaaggcaacaaaaacagaggtataggtggcagggagacatacagaaaagaacaccaaaataaagggaaaaaaattatttcccactcagcatataaaccataaactaaaatcctaaagtgtatttaaaaagtgaactaatgggccaggcgtggtggctcacgcctattatcccagcactttgggaggccaaggcgggcggatcacgaggtcaagagatcgagaccatcctggccaacatggtgaaacactgtctctactaaaaatacaaagattggccgggggtagtggcatgcgcctgtagtcccagctactcaggaggctgagggcaggagaatcacttgaaccttggaggtgaaggttgcagtgagccgagatctcgccactgcactccagcctgagtgacagagcaagaccccacctcaaaaaaaataaataaaaataaaaaataactgaactaaggaagatagtcaagaaattcatcaatatcaaaagatgaattcaatgcttaataaaaatcttgaaattggtttaaaataaatgtttatgatccttaatgagataaagaattggccaggcacagtggctcaagcctacattgccagcactttggaaagctgaggtgggaggctcacttgagcccaggagtttgagaccagcctgggcaacatagcaagctcccatctcgatttttaaaataataattgaaagccattacgaatgataaaaagaaacagaagaataaatggatgttaaaagaactataagctttcacgaattataaataatttgaaaagatagtatcatcaattatccacagccaaactctagacagacatgggatacttgtctgaaaccaagaatcaatagacaaggttaattcctaaactggacacacaagcacacatcattagtgaacaagaaaacaacgaatccaacttaaatgaagcatagtgaagaggggaaaagaacacagacttaacagctgatttgagctcagcatgaccttaccaaatttacatctctgaagctcaatttcatcttctctaaaatgcacatccatcacctttacaaagttgttgagaggattaaaaaccacaggtaaaacaaaacctcagtgatgtctggcaaatggtaggctctcgaaaaatggctccctcaagaactgtaccatttacagacagaatcaaggtaattaagaaaaatggaatttggcctcttaactacaaacagatctacaacctagtttacaaaaaaagatatttgtgttttctaattcctatattactgatacagacaggagacagggaaatactgggtagaagaaggcagttccctggcaaaggccccactcaagcctgaaaacccatgaccctaaatgagaacaaacattcctgttttcatgcctaaaagttgccttttgacccaccacgcccccatatcctgtacccatataaaccccaagcccccggctccacaaggagacaaacagaagagcagaagaatggcagaatggcacggcagagaaagaagagaaggaacatctgaacaccaagaggagttcggctgaggacggtcagagaggagatgggccactggatggccaaattccaggggaagatcattttcccactccatcccctttccagctcctcatccatccaactgacagccaactccatcactcaataaaatccccacattcaccatcctcaagtccgtgtgtgacctgattcttcctcgatgctggacaaggacctgaataccaagaaggccctgagctgtttaacacttaagccgtccatggtcggcaaagcaaaaagagcatactgtaacacatgcctacttgggcttggggagttgcagactcccacccctggacactcccatgagaacagagcccaggggcactcgccccagatcctgcacctgcctgcacgcatgctcctcctcccaaaaggggtttgagagcacggaacagatgagccacagccctgtcgcacgtcctgtgaggggggtcagggaactctcccatttaattagctgaataaattaagcaaattgtctaaatcttggtgcctacaggagaatttaagagatgtctcttgagaaatactaaattctcaaagatgctaagatcttcaaatgaagttttggtagtggtcttgaattgttcttatggcacttaaaatgttttctaaaaacctctctgatatcatacacttctctgtcaaaagaatttgtagaaacggaactcttattaggaaaggcatttgggttacaagtgactaaggattacttcttccttgaaaaatcatgttaacgttcataacttatcgctctgcaattttttttaatctaaagacactggcaatttagcctaaaaaaaacccttcactattcatcactcttaataagatggcttcctttccaactgccaaaaggaaaatggaaagaaactcaggcttctcatatttcaaataaaattaagagagagctatttaagtatggaaacaccaacagtttagatggtaccttcacaccacaaactagacttatcaaaaacctaagtaaaaattctcatacacaaaaataaatttcaactttcttctcagcgcctaggaatcaaagccttaaactactgaatcatgtctggaaatgaaaagacagtaggattacagctgtgcatggccaatttatcttctgaagtcaaagcatttctcctgttaccttgcagcaagtcaatgtgatctgcatataaatatattaaatggtcacagtatctgaaacctataccaaccacaaaaggtgttattttaattaacaagttggcaacattatgagctttacagttttattctagaattctttttgaattatcacaatttaaagaaaatttttaaaggctaagaactcagactaacaattatgccattccaattctatttatgtcaccctccagtaaaatagccctataaatagcttggcaaagagaacagcaatataacaatagttggtttagaaaaaagttaatttctaccatttagtcttctacaacaggacaaaattttatggtaatgaaattaaagaagggccaaatcaaacactatataacaaaagggctatctggaatgtgttacattatttgtaatagcacagaaactataaaagataaattccatgtaaatgaatgaagtagcctgcattgctgatcttccaaatgcttgtgtactcatataagtttaatatattgagctcattaaagatttacacttagtttcttatattaatgataagcaatacatgatggaaaatatatttaaagcttaggaacatatgttgagcatgtgtgcacatgcaaagctttcaaagttgctttaaaatgtgaaaatgaatatggctccccctgttatccttgataaatgtcagctgtcatgtactcatgtccaatacatactatttttcacagagcagagacccagaaaacgcaattttgaacccaccagctgcatgtaatggttatacataagcaaattctatttgaggtcagaagtttaaaggttttcaatatcaacttctaaataatgcaggctttatatgttaaatattacacagattcaaaagcatactccaattagaagtttttggaaacagacaaaatcgtaagaaggcaattactctaaaagtttggcacatgagataggctcatttataacagtgatacaaactggactatttgtacagcagttcaccttttattagattattgagctgatatttaggctaattctatttcttaattaagttacaaaattaagtactataaagctatattattaccgatctaacgattttcatgtctatatctgaaagcttagcagaaagtaaaccgccataacctttggtctttgctatggtttgaatatagtttatctccacaaaactcatgttgaggcttggtccgcgatgtggtattcggaagtggtgcctttaagaggcaagtaagtcgttaagatggattaatgcctttctcactcccttgagttcttgctcccacaggtttggactaaagagtgggttgttacaaagtgagaccacctcttgtgttggtaactttgcacatgcctgcttccccttcctcttctccaccgtggtgttacgacatggcacaaggccctcaccagaagctgaccagatctcagacttcccagcttccagaatcatgtgctaaataaacctttcttttataaactacctagtttctaaccctagaagaccagaacactagaacagaacaccagaaagcagactaagacattctttgactttaataataaaatacaattatcaataggaattgtcttttgaaagcatcccctgtatagtatgtgacctatacttaaaataaattaccttttacagtaagttgtcatatgagcaacactaaattcaagatacaatttttgaattctatctttttttttttttttttttgccagggacagtggctcatgcccgtaatcccaacactttgggaggccaaggagggcagatagcttgagcccaggagttcgaaaccagactgggcaacatggcaaaaccccatctctaccaaaaatacaaaacgttagctgggtgtgctagtgtacgcctgtagtcccagctacttgggtggcttaggtggcaggactgagcttggaaggcggaggctgaagtgagccgagatcacaccactgcactagagcctgggtgacagactgagactccatctcccccaacccacacgcccgccaaaaaaaaaaaacacatttaagcttttaaaattataaatgcggccatgcgcggtggctcacgcctgaaatcccaccactttgggaggccgaggcgggcagattgtctgaggtcacgagttcgagaccagtctggccaacatgatgaaatcctgtctctactaaaaatacaaaaaattagctgggcgtggtggtgggcgcctgtagtcccagctacttgggaggctaaggcaggagaatggcgtgaacccgggaggtggagcttgcagtgagccaagatcgtgccactgcactccagcctgggcaacacagcaagactccatctcaaaaaaaataaaaataaaaaaatatatatatataaaatatataaaatacacacacacacacacacacacacacacacacacaaaggaagtgagagaattagccatcagatcatctcaagtaaaataattggagcttttctacttgtatatactgcacttaactaactagtcctaaacagcagatccaccaggattatgaattttttggtgaattttttttaaactgtagttataaacttgagagcaaacattgatttctggaggcattgcgcaagatagccataaatatctcacaaatgtttagtggacaaacaggaagtggagatggatctgggtatggtctttttaagaatgcaatcttttcaatgtaaactttcttgacacatgaaaaagatatgctgctggaattcatattgaccatataattacaggatgacctctataaaaagactgaataaggttttttaaaatttgaagtgagtgcaattaacatcttatttttgaaatctaacaatgtttgagataggaaaccttttgagatcagtgtcatgaggaaagtaatatttttccataaaatttctgtatgacatcatagtgttcttagcagttttgcatacatcagctagattctttaacagctttactgagatattaattcacatattatatgcttaaagtgcacgactggcttttagtatatttcagagttgtgtaactctcactgtaatcaattttagaacattttcattatcccaaaaagaactcaaaatcccttagctgttattcccccctgctcccattcccaccccctcaacctcatataacccaaccttccacctattcacccctgcccttgacaaccacttacgtatttgcgtctttatggatttacctattcaggacatttaatataaatggcatcacacaatatctagttctttgtgactggcttcttttacttagcatagtgttttcaaatacatcaacattgtagcacatatcggttcagtcatgcctagcttaatgacagggatacattacgagaaatgtgccttcattccatttcatcattgtgcaaacatcacagagtgtcccttaacaaacctagataatacagcctaaatctaggctatatggtatagcctacagctcctacgcaacaaacctatacctatactgcatgttaatatattgaatagcgcaggcaagtgtaatacaatggtatttgtgtatctaagcatatctaaacatagaaaaggtacagtaaaaatacagtataatcttatggaaccactgtcatatatgtggtcctattccttcattgactgaaacattgttatatgctacatgactgtacttcattgctttttatttctggctaatacttcactgtatggatacaccacattttatttatgcacctatcagctgatggaaatttaagttgttgttctgctactatgaatactgttgctatgaatatttgtgtgtaagctgtgtgattatgtatattcttaaatgagaaatcatgagcactaataataaaaataggtttcagccaggtgtggtggctcatgcctgtaatcccagcactttgggaggccaaggcaggaggatcacttgaggtcaggagttcgagaccagcttggccaacatggtgaaaccctgtctctactaaaaataacaaaaattagccaggcatggtggcacgcacctgtaatcccagctactcaggaggctgaggcaggagaaccgcgtgaacccaggaggtggaggttgcagtgagcagagattgtgccacggcactccaacctgagcgacagagcgaaactccatctcaaaataaaataaaataaaaacaggtttgataatacatgtaaatgatgcttccaaagttcgctagtaaacagtaaagaagccaggttcttttttttttttttttttttgagacagagtctcgccctatcgcccaggctggagtgcagtggcgtgatcttggctcactgcaagctccgcctcccacattcacgccattctcctgcctcagcctccagagtagctgggactacaggcgcccgccaccacgcctggctaatttttttgtattttttagtggagatggggtttcattgcgttagccaggatggtctcaatctcctgacctcatgatccgcccacctcggcctcctaaagtgctgggattacaggcgtgagccaccacgcccggcagaagcctggttctttaaaaacatttattctaaaaatctaaaaaccaatcatggaatcttaactatgattaatatgttaacgggctctaatggggaaagcagacaacatgcaagaagagatgggtaatgtaagcagagagataaaaactctaaggaggaatcaaaaggaaaggttaggccaggtgcggtggctcacacctgtaatcccagcactttgggaggccgaggccggtggatcacctgaggtcaggagttcaagaccagcctggacaatatggagagaccctatctctactaaaaacacaaaaagtagctgggcttggtggcgagtacctgtaatcccagctactcgggaggctgaggcaggagaatggcatgaacccgggaggcagaggttacagttagccgagatcgcaccactgcactccagcctaggcgacagagcgaaactccatctccccctcccaaaaaaaaaaaaaaaagcacaggttagaatcaaaaaagactaacagaaatgcaaaatgcctttgatgggctcatcagtagaccaaacataggagtgggagaccagagagccttaagatcaatacaaactccccaaaactgaaaaagaaagagaaaatgaaaaagaaaagaatatccaagaatggtgggacaattataaaaggtgtaacacacacaaaatgggaatactattcacatgaaattttagaaaaggtaaaacagtagtgacataaagcagaccagttggaggtttcttctggttgctagggaccagtggagatgactgattgcacagaggcacaaagaactttagggaatggtagaaatgttttatatcatgactgtggtgatggtcacatttgtcaaaactcattaaattgtaaatgtaaggttggtaaatattttgtatgtatattatgctttaataaagttggttttttgaaatcaagtacttaaggaaaattacagtgcttattgctaatcctatgataaataaaaagtgatatgaaataacttagctaataaaacaagaaacaatgtataaaacatttcagtaagaaaatttacttttggcttagtatggtgcctcacacctgtaatcccagcacttcaggaggccgaggcaggtggatcgcttgagctcagttcgagaccaccctgggcaacatgttgaaatccccatctctaccaaaaatgtaaaaatattaattagtcaagtgtggtggcaagcgcctgtagtcccagctactcaagaggctgaggtgggagtatcgcttgagactgggcggcagaggctgcagtaagccaagatcatggcactgcagttcagcctgggcaacagtgtgagaccctgtctaaaatttaaaaaaagaaagaaaatttactttttctaaagtagtaccaccacattgaaagcaaatatattagcagttaaaatcaagtttgtttaaaactttagagcaataaaaatattttaaacgagatacaaaaaatgatcattgcaacgttgttcacacttcaaaagctagaagaaactctaatgtttatcaattgcagatttgaaaaatgaattctaatgaagccatgcaaaagaatacaatacagggatggtaaaaatgaattatacacaacatggttggatcttacaatttagaaagccaccacattacatccattatatttttggaaagctaaaaaaaacaagaaaactaaacattgttcaaggacacatccaaatgagactttttcaaagttttttaaatgaagttaattattaactcaaagatagctgtgacttcaaggatagaagcaggatgacttcgggaagaaagattcagggagcaggtacactatacgaactgaccgtcccgttcttcagttcaaggagtgggttcaagaatagccttcaaagtatacttcataattcaaataatatatactctttatttatataaaaataatgtgtaattttagtgtttaaagtaaaaaatcactatgtgaacaaatacttgctctaacatctgagtgaggtattgtgataaatgcattccacttattactcccatttaatcctcctgacagccctatgaaacacagaatagtgagctagatgaaagtacagttcaatattatccctacttcacttgaaaacactgagacatcgaaaggtaaactcaacccaaagtcatacatccagtaagtggtggagctagaaattaaatccaagtcattctaacttcagagccaagcttttaaccaatcccaccaaaaaattaaaaaaaaaaaaagccttatgtcatggcatcaaatattttatttttttcatggaatctcagtaaagccacatcacttacagctattctaacagtttagatagaactggccttactggacttccaataataaatcactcttttccagccacaccaagtggaagatcccaccagtctaaaaaatttaaaaccagttataaatcacggtcctttgcaagttaagcgccagccaaggactgtagattcttgacctatccctatagatatctcctgtaaaaaattattttaaggccaggcgtggtggctcactcctgtaatcccagcacactttggtaggccaaggcgggcggatcacctgaggtcagaagtttgagaccagcctggccaacatggtgaaaccccatctctactaaaaataaaaaattagctgggcatggtggtacgtgcctgtagtcccagctactcagggagctgaggcagcagaatcgcttgaacccaacaggcagaggttgcagtgagccgagatggcgccgctgcactccaactagggtgacagagtgagagtgtctttaaaaaaaaaaaaaaggtcattttaaaggctgggcgtggtggctcacacctgtaatcccatcactttgggaggcaaaggcaggcggattgcctgaggtcaggggatcgagaccagcctggccagcgtggcaaaattccatctctactaaaaatacaaaaattagccagtcgtggtggcgggtgcctgtaatcccagctactcaggaggctgaggcaggagaattacttgaactcggaaggcagaggttgcagtgagctgagatcgcggtactgcgctccagactgggcggcaacagcaaaactgtctccaaaaaaaaaaaaaaaaaaaaatcaggtattctgcccacctcagccttccaaagtgctgggattacaggcgtgagccaccgtgcccagcaatatcatgaagactttcatcttctctttttttttttttttttttttttttttttttgagacagagtctcgctctgtcgcccagcctggagtgcagtggcacaatctccactcactgcaacctccacctcccaggttcaagggattctcctgcctcagcctcctgagtagctgggattacaggtgcctgccaacacgccaggctaattgttttgtatttttagtagagacgagatctcatcatgttggccaggctggtttcgaactcctgacctcaagtgatctgcccacctaggcctcccaaagtgctaggattacaggcatgagccactgcacctggccaagactttcatcttctaatctgactggttatcacgcatcttgagtggtgtaacagcagttagcaggtaactaaaaggttccgtaatgtagaatctgatccgtcaatcatagaaaattaaagctggaaagaacctgagattatgtgtaaaacaagtgaactggtcattatgaagaaaatgatgccaagatgagactactactcttcctagttcccatctggcaacatgtgttttctggctttaaatatgagaggtgttatatccaaggcaaaatcaacaaatgttgatttttatacataaggcaatacaaacctaaaaacaattcacttaagttgtttggtttttaagtaatcgttgccttataggatttctatgaatttggttcatattttaattagaaggcatgaatgcagaatttataattaaaatgtttacctttaaactttagaaatttaatttcaaaataaactgaaggagaaatataaatatacggttactacaactaagaatgtcattcttatgccagtaattcttttcccatactactaattatcttataaggttctaacagaactttagaaactagaattttaggaaaatgtttatataaaggcacttgataattatcctggcttagtaatgctttcattcctttaccaaactttataatgttcttattttaactaagatgacacaaaaactggtttaaaaattttcatgaagttaaatccatcaacttggccaggcgcagtggctcacgtctgtaatcctagcgctttgggaggccgaggcaggcggatcacgaggtcaggagatcgagaccatcctggctaacatggtgaaaccccatctctactaaaaatacaaaaaaaattagccgggcgtggtggcgggcgcctgtagtcgcagctactccggaggctgaggcaggagaatggagtgaacccgggaggtggagcttgcagtgagccgcgacgcaccactgcactccagcctgggcaacagagcgagactgtctcaaaaaaaaaaaaaaaaaaaaaaaaaaaatccatcaactcaagaggaggtactccaaagagttaatttccgagacaatgaatgataccgcagtctgggattccaaagtcttgattttaaaacgtatgtggtggccgggtgcagtggctcaggcctgtagtcccagcactttgggaggccgaggcaggtggatcacctgaggtcaggaggtcaagaccagcctggccaacatggtgaaactccatctctacaaaatacaaaacattagcagggtgtggtggcggatgcctgtaacccgagctacttgagaggctgaggcaggaaaatcgcttgaacctgggaggcagagattgtagtgagaggagatcacactactgcactccagcctgggcaacaagagcaaaactctgtctcaaaaaaacagtctgtcattagaattaaatttttctgttgagtaaccacagacatactttcactgctggaggaatgtcatctaaaaagattagttcaaggtattactgacttcaggatacttaaattcttcaactgaaaaccgttttttaaatgagaagaacttcaattttctgcaatttgacaatgttgttaattaagtagcatccgctaccaggaccaccactcacaccagttacagtatgaacattttaactgacagcaacttattagaagataaagatcatggcattatggaaagaaaatggtctgtagtttgtaaacaatcaagttaggttctaatttcagttctgccacaaactaggtatataactttgataaacctgttaccttttctgaagcctctatcaaccccaacacagggctgtaggaatgaaataagaggtaaaagtatttcattgttgaatagtgcttagaaattgagttggcagaaaaagtcactgaacttgaagggatatcaaaagaattatccaatttgaagaagagaaaggaagaagactgaagaaaaatggttagaaccttaatgacttataaacatatcaaatggtcggctgggcctggtggctcacacctgtaatcccagcactttgggaggctggggcagatggatcacctgaggtcaggagttcaagaccagcctggccaacatggcaaaaccccatctctactaaaaatacaaaaaaaattagccaggtgtggtggcaagcacctgtaatcccagctactcaggagctgaggcaggagaattgcttgaacccaggaggcggaggttgcagtgagccaaaagagcaccactgcactccagcctggggtacaagaacgaaactccacctcaaaacaaaagaaaatcaaatggcctagcaagtatgattggagtcccagaggaaggagaattaaattgaagcagagatgcagaaaaagtacttgaagaatggccaaaactttccatatttgatgaaaacacaaatttacaaatccaagaagctcaaagaataccatgcaggataaatacaaagaaaactagacctaaatacatagtcaaactattttaaaccaaacgtaaaaagaaaatcttaaaagtatccacaagaaaaaaagaccacacatactgagaacaagattaaaaatcaactcttcaaaaaaaaaaaggggaggaggttacaacaccacagaacaactttaaagtgctgaaataaaaaaatcaacaacccagaattttctatccagtgaaccaaaccttcaaaaatagggtgaaataaagacattttcagataaataaaagttgagacaatcagtgataaacaattctggaaatgaaattatatccttcaggccaaagagaaaggggcatcagatgaaaatgcacatctataaagatgaatgaagagtaccagaaatgtcttactgtcaaatgggtgatggcttctgctactctccgatgcttcccttgaggactcatatgctataatttgtcttcaaaggacagttgaagattctcatgcaaaagactgtacaaagtacctttaaatcttgataatttatgaaatactctgggcaatgaactactgagctaacatttttaaattttaaaactatactaaaggccaaaatgtctaggtatcttaaacatctaagcagacaacttaaaagtgactacagaataagcctaagagaaacagaattaactgcataggactaaatgaactagtggcagaaatttaaccagttgtttcagactatggttttttcttttgttttttcttttgtcttttgttttttgtcttgagacacaatcttactctgtttcccaggctggaatgcaatggtgcgatctcggctcactgcagcctctgccccctggggttcaagtgattcttatgcctcagcctcccgagtagctgggattacaggcacccatcaccacccccagctaatttttacgtttttagtagagagaggtttcaccacgttggtcaggctggtcttgaactcctgacctcaggtgatcaacctgcctcagcctcccaaagtgctgggactacaggtatgagccaccatgcccagccgttttttgttttgttttgaggcagggtcttggtctcttgcccaggatggggtgcgatggtgcgatcacggctcactgaggcatcagcctcccagcgtcaagcgatcctcctacctcagcctccccagcagctgggaccacaggcatgtgacacacaatgcccagttaatgtttttattttttatttttgtagagacggggtcttaccatattgcccaggctggtgttattttttaatattctgttttctgatggctatatgaggaagcccttttcctttcttcttcatctacctctagctcacaatttaatatattatgcttttgtaggaaaatttttaaatggcatttgagagcggtggcgcatgcctgtagtcccagctactcaggaggctgaggcaggactgcttgagtccaggaattcaagattgcaatgagccacaatcataccactgcactccaggtaggtcaagagagtgagaccccacctcaaaataaagtaaaaactaagtctattttttcatgttaataacgttatttgcataggcttaatcaaattccgtcaagacaaaggtaaataaaatttaccaggataactggacaaatcattgtacaatctaggtcatatactatttcttataattaagaacaatataatgatataatgtcatataattataatataatcgtatgacaagtccaccactataacaaagatagtagggcaggacacagtggctcacacctgtaatcccagcaccaacacttggggaaaccaatgcagggggattatttgagcccaggagttcaagactagcctaggcaatatagtgatacctcacttccacaaaacattttaaataaacatcttataaattaaaaaatttttttaaaaagaaaacaaagattttacattatacaagaagtcaatgtttatgggcctggtacctgttcttggtttacagggactagcttcacagatggaaggtcacttagtggcagccaatgactcagtaaatttagggaacctgaacaagagatgacttcatccaaatttataagtattccaagtgaaatctggtggagagggtattgtatttgtttcctagtttcaggataaaagaacaaataaaagagactttaaaagttcaagtcagccaggtgcagtggctcatgcctataatcccagaactttgggaggtcaaggagggtgtatcacctgagtcaggagctcgagatcaacctggacaacatggcaaaaccccgtcactacttaaaaaaaaaaaattagctgggcttagtagtgggcacctgtaatcccagctactcaggaggctggggcaggagaatcacttgaaccagggaggcagaggttgcagtgagctgagggtgcgccactgcacgtcagcctgagtgacagagcgagactctatctcaaaaaaataaataaagtcctataatcagacaatgtatatgggcatgaggatggcactgaatagaggccagaaagagactttggcaaatataatcaattaatcaagttaccaaagcaaaccaagaaaaaaggaacatcttttctacaaatagccctggaactggatatctataatttaatcaaaagttggtcctctggccgggcacaatggcttacacctgtagcttactcccaagcactttgggaagctgaggcgggtggatcacctgaggtcaggagtttgaaaccagcctggtcaacatggtgaaaacctgtctctactaaaaaaaaatacaaaaattagacgggcatgctgttgggcatttgtagtcccagatacttgggaggctgaggcaggagaatctcttgaacctgggaggcagaggttgcagtgagctgagattgcaccactgtactccagcctgagagacaagagccaaattcagtctttaaaagaaaaaaaagttgtattttatattctgtaaattttactacaattaaaataaatgaatgggaaagatctctttggcatgatagggcattatttccaggagatatcagttaagtaggaaaaaaagcaaagtgcaagagtatatatagtacgctatcttttgtataaataaataaataaaacatacagataccatcaaaaaaaagaaatgggaaggataagacagaaaacatttaagttggttacctaagaaaactgaagaaaaatggcatggaagggatacaaaagcaatgtatgccttttgtataattttgacttttgaaagcatgttattattctacatattacaaaaataaaaatcagaatgggaggcagcataagcaaacaagtaaataaacttaattttgtttcaaatgaataccctaactagtttatacagaaagtaaggtgggaagtaaaagtggggtggaggtcgggcgtggtggctcactcctgtaatcccagcaccttgggaggcagaggcgggcggatcgcctgacctcaggagttggagaccagcttgggcaacgtggtgagaccctgtctctattaaagatacaaaaattagctgggcatggtggcacgcacctgtagttgcagctactcaggaggctgaggcagaagaatcccatgaacccagaaggcagaggttgcagtgagccaaggtcgcaccactgcactccagcctgagcaaccaagactgcctcaaaaaaaaaaaaaaaaaaaaaaaaaaagtggggtggagaaagggtatggagggctaatccaagcaatttaaattttaactgtttactctcggtcttgggtaaaattgggaggtggagaagaattatagacaaatgctccactcattttcagtttgtttattgcagtgaaatgaaaaaaccaattctgaaattattttagatgtattagaggattaggcaaatgagtaaatgtactaaggttgagagtcaggattcccacataataataagggacataaaaataaaaaatgaagtacaaagaaccctgtagacatggaataaagacgtacatactgatataagctcatgatttctaaaatatgtatatgtatgtttcaatgaacacatgcgaagtcggccctctgtatcgtggattctgcatccatggatcaaaaatactcaaaaaataaatttaaaaaaacaatacagcaataaaatacaaattaaaaaatacagtttaacaacaacctacacagtatttacactgtgttagattcttataagtaatctagagatgacttaaagcatacaagaaattgaacatgggttatatgcaaatacaattgctactttatagtttaaagaacttaagcatcagcagattttggtgcacacaaagggtcttagacccaatcaccctcaggtacgaagggatgactgtatgagtatgtatatgtacatgtatgtgtataagcatgcatattatttcctagctctatccactaaaaaggccaagatgagaaaacagcccagaagtagtgaggacacctagcactcagagagatcttggtctctaaaacttttattccccacaaggacacagcggcccacttacaggagtttcactagccaaacttctaggacaatttgagcactaaaataattaagcagggtaagtgaattgtaaaccattcaaaaaataggaattcatgaatccatcaccaatacatagggctattgattatggaatacagccaagatccgacgggtaatgggaaaggaatgctggaaagaaaaaaatgaccattttgcaatcatcacaataaaaagctggatcagacaagagtcaatggatgctaaatctagaagaaaccgtgaaaagaatcagaatatctgcattgtttccccacaagctgcttattgcttggcaaaagagagggcaaaaaaaccaaatggtggagaaatctggcaacaccttggccaagggatcaaaatttgcatcacaataagggacagacggacgtcatatgactccatctcagagtatcacattgcggatgcagtattcctgccaagaatccataacatcttaatctaatcacaaggaaatttcagaccaacataaaatgaagaacatctccactgaacagagtaaaggggttagggaagggttgtgttctcaaaaatgccaatgtcataagagataaagacaggctgtgaaaatatcccaggaaaaaggaggccaaagagaaataataactgaatgcagaacctgaccccagactgtagtctatacaggaagcatagaaaatgctacaagagactttcttaggtcaactgacaaaactggaatatgggcgatagatttcatcgatgtccatttatgaagttattaactgtaccatggttatataagagaatgaccctatctgtaggaatacaacagaagtattaggggaaagaagcataacatatgtaactcaccctcaaatggttaaaaaaaaaaattgtgtgtgtgtttacgtgggtagaaaaagagaaaagagagtaggacagcacaaatacaaataagcaagtgggtaagtctggataacggatatccagatgttctttatactatatttttgtaacttttgtaaatgtatacttccaaataaaaggtatttaaaaaagaaaaaattggccgagcacagtggttcacacctgtaaccccagcactttgggaggccgaggcaggtagatcacctaaggtcaggagttcaagaccagcctggccaacatggtgaaaccccgtctctactaaaaatacaaaattagccgggcagggtggcgcgtgcctgtaatcccagctactcaggaggctgaggcaggagaatcacttgaccctggaagtggaggttgcagtgaaacaagatcgcgccattgcactccaagctgggtaacaaactctgtctcaaaaaaaaaaaaaaaaaacctgtggagatagttctctgccatgttcagaagaatgggtatatatcacaattaactgagggattttacagggaaattgcaagacctaaggctggtaacttggatagattctcagataaagtaccatttgaaatgtcagagaagggagtttgtactttttctttctgtaagccaaggaaaggtagcacaaaacttagagcacaacataagcttggctaaaagtatacatttaggaaaatctagctaaattttaagtgagtggacaaggaagcagtagagacaaggaaaaacaccctcatgaaattatggggtcttggcctcggaagctaaaattaggaacagaaagtggaacaaatacaggacacatgaaaatagaaagccagataaagcctgcttaccaaatgaatcagagtacggtgggattcaaagacaactcagatttcaaacctagctaaccaagagaatgatgggattaccaaaagaaatttagctaagcaaagcatgattgttttctcggcaactagacagctttttctattctcatttttcctattctgatgtaatattaaaagttaagaaaaggggccaggcgtagtggctcacgcctataatcccagcactttaggccaaggcaggcacgtcacttgaggccaggagtttcagcctggccaacatggtgaaatcccatctctaccaaaaatacaaaacttagccggatgtggccgtgcacgcctgtaatcccagctacttgggaggctgaggcatgagaattgcttgaatccaggaggcagaagctgcagtaagccgagatcacaccactgcactccagcctgggtgacagagggagtctgtctcaaaaaaaaaaaaaaaaaaaaaaaaagttaagaaaggggttagatgaaatgttatttgccagcacaagcaatctggggaaatttgtcttcacaaggtgaaacagcaaatgtaagttaggctaattcagatgtttgactaaatgccattaaaatattcacacataaggagggggaatttcttctcttcccccaaaattatgtttgtatttgtatgtatatacatatatacgaataccataaccccttgtacaacacatttgaactgcatttgttctgttatacgcagatttttctctatttctgccatgcctaagacagtaggaccaacatttcctcttctttctcctcctcaagcctactcaacctcacgaaaagaatgaagacctttatgatgatccacttaatgaataatatgtatattttctcttccttatgacttttttttttttttttgagatgaagtctcactctgttgcccaggctggagtgctgtagcatgatctcagctcactacaacctccacctccaaggttcaagtgattttcctgcctcagcttttcgagtagctgggattacaggcacacgccactatgcccggctaatttttgtatttttagtagagacggagcttcaccacattggccaggctggtctcaaactcctaacctcaggtgatccacccaccttggcctcccaaagtgctgggattacaggcatgcgccaccgcatccggccatgtctttcctttttaattatttatttatttacttattttctagagacaaggtttcatactgttgcccatgctgaagtgtagtggtgcagtcatagctcactgcagcttcaaactcctgagatcaagcaatctcccacctcagcctcccaagcagctaggactacaagcgcacaccaccttgctagctaattttttgtgtgttttgtagaactgggggtgttactgtgttgtttaggctggtctccaactcctggcctcaagtgatcctcccacctccaatccccaaagtgctaggatc

SEQ ID NO: 23 - DNA, 260209 bp, Homo sapiens
  misc_feature (1)...(260209): n = A,T,C or G
  misc_feature 25891, 27411, 27421, 31218, 185592, 185601, 185605, 185662,190170, 190172, 190174, 193398, 193904, 194384, 195071: n = A,T,C or G
  misc_feature 195073, 195076, 195081, 204349, 204351, 204353, 205272, 212872,212874, 212879, 212884, 212885, 214984, 214986: n = A,T,C or G
  misc_feature 214988, 222384, 226726, 226747, 226807, 228338, 228341, 230462,230540, 242008, 243283, 243413, 243414, 243415: n = A,T,C or G
  misc_feature 243416, 243417, 243418, 243419, 243420, 243421, 243422, 243423,243424, 243425, 243426, 243428, 243429, 243430: n = A,T,C or G
  misc_feature 243431, 243432, 243434, 243435, 243436, 243437, 243438, 243442,243443, 243444, 243446, 243447, 243449, 243452: n = A,T,C or G
gaattctgagtttttgtctatctttattttggccaaattatgtttctaagtaactttttcaggctgatagacatttttttgagaccttgccatatctctgaattgtttctgctgtcttatacatgaatgaaaatttgaatctcttgtttatttactgtttattccaaatattttctaaatttgatgctattgctaaatgaaatgaaatttcattttctgcttatattagatgtcagtgtatttattctgaaaaggcacattattaaatcaatttatgatttagttttttaattgactttttaactttcctgaaagataattctatcatctgaaaatacagaagctcccctttaagaataattcactttcaaaaagttgttcactatctcaaatattattagtccaaactgacaacacataagtaattgctctcagcatccaatggtagtgagaagagaggatgtccttttgctcaggtaattaaaataagttaacatttataatattaggtttaaatgtgtgtcatgcctgcagaaacaaagtcaaatgcaaatgctagcaataaatcttgaaaggaatacaagatataattagattaagttaattatttaggagcaaatgccattgtcttaataaattaaacacatattatttttagtaaattaaacactgataaactactaagttcaggaagaaggataaaaaagtaacagtaagctaagtaactttccaaaaatttgggtacattcttaacttgggttattaaagaaatataattttaagattctttatcttccatatcattgccaaatgccaatgtaatgtatgtttcccatattgtttgggaatgttcagctctggtttagaaagctagcaaaacaaatgggaaaataaatgtgttaagaatagacagttattgagcaaacagcttatgagacatgagagaaactcataagatgtattaattgtagataataagtaagcaagcagcttgagagacaaagacagaatacccaagatttactaaatatatagtaagttagtagccactaacacatgttaaagatagataaaataagtggactatatgatggagcaaacaaaaatgatacttacagaaagagatggaaagaccaagtaataaattatagatcatgttgcctgtagcctgatggctatgtcatctccaaactggccacccactggtaacacctatcatggtctcattctgtccctacttgtgctttgctcaagaaattaaaaaacaaacaaacaaaagccaggactgatcagcaggccaattggcaagtcaccacaggggctaggcatatttatctgtgtctcttgaatacagcaagtcagtgtgttgacaccagataacttccacctgttggacctcttcataatcacaccatcagctgggaggacacgtgagtcaaaaacaaaggatcgctgggcacggtggctcacgcctgtaatcctgacactttgtgaggctgaggcgggtggatcatctgaggtcaggagttcaagaccagcctggccaacatggtgaaaccccatctctactaaaaatacaaaaattagccaggtgtggtggtgcactcctgtaatcccagctactcaagaggctgaggcaggagaattgcttgatcccaggagttggaggtagcagtgggccaagatcatgccactgcactccagcctgggcaacagagcaagactccatctcaaaaaaaaaaagaaaggatcagaagtcaggcagtgttgtcctttcactctgcctacatcctatcctaagtgaatttacctctctcatctcttcccctagcctctcactacgtattttcaagtgatttaataaaaccatgtgatttgaacattttaatttggtctgtgagtgattctgttccatgactgctgggagagtttgcatggttaatatatttgggagtagtgttgcacaaaggtaatttcccatgtgacagtaaaattaagaaaaaatatattaatcactatataaaaaggcaaagtctcaattatgttccataaaaaatctaatcattcaatttacaagttaaacaaattaccatagaaaattaatagtaaatgcttgagcaaaaataaatcaagcaaacatcaatcaaagaaagcatgtttgtaatgtggattgataaacttaagtactagcaaattaactttaagagttcagcaattcttaaatagaaagcccataaataaatccacccacatacagtaaagtgatttttgacaaagatgttaagagcacacaatggaaaaaggatcgtctcttcaataaatggtcttgagaaaactggatatcaatatgcagaagaatgaaattggacccctatgacatacgatatgcaaaaataactcagaatggataaggcttaaagataagacctgaattgtaaaattgctcgaagaaaacataaggaaaaatctgatattttcccttgacattagtctgagcaatgatttttttggatatgacctcaaaaacaaagacaacaaaaacaaaaataaacaagtgagcgcatgtcaaactgatcttctgtagagcaaagggaacaatcaacagagtgaaaagacaacctacgaaataggataatatatttgcaaaccatacatataaaaaaggggttaatatcctaaacatctaagaaactcaaacaactcaattgtaagaaaacaacctgattaaaaaataggcaaaggacttttatagaactgctattataaaaaaaaaaaaaaaagaaaagaaaggtagcaagcgttggcaaggatgtggaaaggggaacactggcaaactgttggtgggaatgtaaattagaacagccattatggaagacatatgaaatttcctcaaaaaattaaaaatagaattacaatttaatccaacaatcccactactgggtgtgtacccaaaggaactgaaattagtatgtcaaagaaatatctgcacctccctgtcaattgcagcattatggttgctcataaaaaccaagatacaggccgggcgcggtggctcacgcctgtaatcccagcactttgggaggccgaggcgggtggatcatgaggtcaggagatcgagaccatcctggctaacaaggtgaaaccctgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtacggcctgggcgacagagcgagactccgtctcaataaaaaaaaaaaaaaaaaaaaaaaaaacaccaagatacagaatcaacctaagtgtccattgacagatgaatgaacaaaaaattatgatccgtatatccatatattggcaatgaaatactatcatatatatgtaatatgtataatagcacatatatattgcatatatacacacacacacatatatgcaatggaatattattcagcctttaaaaacaaagaaatcgtgttgtggatgaatctagaggacattttgctaagtgaaataagccaggcacagccacacaaatagtgcataacctcacttgtatgtagaacctaaataagtcaaactcagaagcagagagtggaatgatggttgccaggagatggtgggggggtgggtggggggaagggaagggaacaatagagggtagggaggatagagcaatattggttaaggggtacgatgtttcagttagacaggataagcaaattcagatttattgattgtataacatgatgactgtagttaataatttattgtatacttgaaactcgataagagggtagatctaaaatattctcagcacaaataaatgttaagtacgtgaggtgatggatatgttaattagcttcatttaaccatttcacaatgtatacatatattaaaacatcacattatacaccataaatacatacaatttttgtcaactatcttaacaaaaaataaaattttaaataaatgcattttttaaaaataattttaagagttcagcagttcttaaatccaccatcatgtgttccaaatctgtgagcaagaaaggaatggatttgcattgaatgtgtcaggaatcacacacaatctgctatccatcttactgacacagtggcctgtggtaagcaactcttcccagtgaaagttatgcctgccttcaaaataccatgtctgtcatgctggaaaaatacaaaagtcagatgcaactgaatgttgagtcagagaaagataagaaaggatcactgtcaggaaacttaacactataaatcatctggaaaaataaatagataaataaatccatgtgaaaatttttacagacaacaaaaaaaaagaaaaaaattttagaaacaacaaaaaaaggtatcttttaagcaactaaacaactaaagtaactaaactaaaaaataacaactgaaatgaaaagctagcattaaaacttctgcaaagtatgttgagtagaacttttctttgtgcatcagaattggtggtgatcacagtctcagttgaaaataaatgatatgaagtactcaaatttttatgatctaccacagttggatccagacaagctcacaaccattcccaccacctgtattaagaagtggcagactctatcctacctctgtcaaatctcaccactccttcttaccctgctcccaccagtcagtctaaggaaagaactagcagaaagagaagggtcatttaggtgatcagtctcatggagttacagaatttatgaaatgagatcttccttcccaagagaggtggggcactgagggcaatcactggaacagactgaagaacctatgagttgggagactggcttctgttcccatcaggaggctcactaagccatagaacatgatctttagtctgtttctcacctggacatttctagagacaagaggcttgctggacaactcaccaaagaagatagtgctgactacttgctctcttggctctctgtgcctcagaagatggcttctgtggctccatagaggtacagatgatgaagatggagcacatcagcagaaacctgtagcagcagatagaccctgaccaagctatagtgaggcccgggagtcactagcttgcccacagtggatgccctatatttcttaaataataagtgaatgaccaaaccatcaaataatttttaaaattttctgaatacagcttataaatctatccatttcttatttttattatactaagaacacttaacatgagatctacccttttaaagtgtccagtacattattgtggactataggtttaagtgactttttgatacacctccaatgagtcttatatttcaagatgcatttcaattttgtatatatttcatgtctcccttcatattttataatttccttgagagtaaggaccaggttctttttttttttttcttttgagacatagtctcgctctgtcgccccagctggactgcagtagtgcgatctcagctcactgcaagctccgccttccgggttcaccccattctcctgcctcagcctccccagtagctgggactacaggcacccgccaccatgcccggataattttttgtagttttagtagagatggggtttcaccgtgttagccaggatgatcttgatctcctgacctcgtaatccgcccgccttggcctcccaaagtgctgggattacaggtgtgagccaccgcgccaggccaggaccaggttcttacttaacctattactatatcctggataccatctcaagctagcgttttgagcagagatactgaagaatgttcctaaatgagtaaatagatgaataaatacctagtgtatcaaatgaccaatacacttgcctgaatcaacttctgctacacactggtcacacattccaagattaatacaattactacttttgatcttatctgtaattttagtagaaaagtttaggaagaaaggccactatttcctagcagcaataatgcccctctaaaaccacccttggtcccatatctccattaagaacctgtcccctctcccactacccttgtactggcaattctccaaagggttgtctacacttggataaggtagttacatttactgtgattgtgtgtgtgtgtgtgtgtgtgtgagagagagagagagagaaagaggaaggaaggaaggaaggaaggaaggaaggaaggaaggaaggaaggaaggaaggaaaaacagttgaggaggaattcggggaagagaccaggtcatgcattcattgggatatgttgaatttaagatgcctctgagacatccaggtgaaattgctgagtgagcaggtatgtggtcatggggttggcttattctaggatgtcctagaatcctgcatccacaaatgtgggcctatcactgcttccaccccaatttccacataatacacatcaaataaatgtttgctgagtcagataaatttaacatttgtcatattatcttcatttcttatatcacaacgttttcttccttttattttttactttctccttgtttctttccttccttcttttctcttgttcttttcttccttctccaacatatatttatttgagtgcctattatctgccagagatcatactgaacctcaagaatataatgtttagcaatctaggcaatacaatgcaggacataggcatggacaaaaatttcatgacagagatgccaaaagcaattgcaatgaaatcaaaaattgacaaatcagatctaattaaactaaagagcttctgtactgcaaaagaaactatcaacagagcaaacagcctacagaacaggagaaaaacgttgcaaactatgcatctgacaaaggtctagtatccaaaatctataaggaacttaaacaaatatacaagaaaaaaacaactctattaaaaactgggcaaaggatataaacagacacttttcaaaaaaagacatgcatgcagacaacaattatatgaaaaaaatagctcaacatcactgatcattagagaaatgcaaatcaaaaccacaatgagattccatctcatgccagtcagaatggtgattattaaaaagtcaaaaaataacagatgctggtgaggttgtggagaaaaagaaacatttatgcactgttggtggaagtgtaaattagttcaaccattgtggaagacaatgtggtgattccttaaagacctaaagacaaaaatgccatttgtcccagcaatcccattactgggtatatacccaaaagaatacaacttattctattataacgacacatacagggttatgttcattgcagcattattcacaagagctaagaaatggaatcaacctaaatgcccatcaatgatagactggataaagaaaatgtggtacatatacattatgaaatactatgcagccataaaaagaatgagatcgtgtccttttcagggacgtggatggagctggaggccattatccttagcaaacaaacacaggaacagaaaaccaaataccacctgttctcacttttaagtgggagctaaattatgagaacacatggacacatagaggagaacaactgacaaagcagcctactagaggatggagggtaggaggagggagaagatcaggaaaaataacatatgggtacaaggcttaatacctgggtcataaaataatctgcacaacaaacccccatgatacaagtttacctaagtaacaaacccacacaggtacccatgaacttaaaaatgtttttaaaaaaagaaaataatgcttagcacaaacgagtcatttccctctcctctgcaaacttacaatacagggtagagagtgatgttatttaaataaataaataaatgaataaaattaataagaaacaatgctgttaagtgctgtgaagcaaaagcacatgatatgttacatgggagtggctgatgtagcctcacctgggtaacggataaagggaagcttctctaatgaggtgggctgagagctgaaggatgcatcagtgtgaacttggagtcaaggtcaagagcaagaataaggagggatctgtgcagaggacccgtggtggaaggaggaccacatggcattcaaggctctgcaaggttcctgtggatggtgattagaggatcgtggagaaagtactataaaatgaggtttgcttgccatccatttttacttaattttttagctttctcttttcctgttcttgtgtatccttttgtcttcatcattatattttatctttatttttcaatagcttaaatattgaataactaaagtaacatcagcacatttcatcatcctcccaagtcttggatgtaaactctgaatcataatttgggaaacatggaaagttggaaaagagttcaaggagattcatattcttaaagagcgtgaaaatgacattttaaaaatttaaataattcatactttgaggaggaacaacttaaaagtgtccagtacctattgagtgggaatacagagtgaattattaaaggagaattaaaatacctgttcatacttgtctcttgatttgccacccgcttgtacgccattagctacagtcgttttttatcattctgcagattttaattgttttgattaacggcacatattcttcaaatgcagcacattaaaaaaactataaaatgatgaaaaaagaattctgcacaatcacctcaatatattatttatcagacctgtaaatcaaatattttacaccaagttgtctccaggtcattcagagctggaatttaaaaaagcaaaggtagtgataaatatatctaaattgactttacatttatcatatataaacatgatatatatggacaatatagaactgggccataatcccaaaaggcacaatcccaaacattgaaatctcaaaagatcaaaatcctgaaaatacggccaggcatggtagttcatgtccgtaatcccagcagtttgggaggctgaggtgggcagattgcttgagcccaggagttcaagtccatcctgaacaacataatgagaccttgtgtctacaaaaaaatcaaaaaaattagctgggcatggtggtgcatgactttagtcccagctactcaggaaggtgaggtagcagaactaattgagctcgggaagttgaggctgcaatgagccgtgatcacaccactgcactccagcctgggtgacagaatgagaccctgtctcaaaaaaaaaaaaaaaaaaaaatcctgaaaatataattctagaaaaaataattttaaaacattcttttaaaaacatgtatttggctgggtgcagtggctcacgtctgtgatcccagcactttgggaggccaaggcgggtggaccacctgaggtcaggagttcaagatcaacctggccaacacggcaaaacctgtctctaccaaaaatacaaaaattagccagacatggtgcagacacctgtaatcccagctactcgggtggctgaggcaagagaatcacttgaaccctggaggcagatgttgcagtgagccgagattgcaccaatgcactctggcctgggcgacagagactctgtctcaaaaaaaaaaaaaatatatatatatatatgtgtgtgtgtgtgtgtgtgtgtatatatatatatgtatgtgtgtgtatatatatatatattcacatttttaaatgggaatttatttgaaaaatgtatgaaagcataacggaacatttcataggccactttacacaataaattaggcaataataacttacatatttttgtaagcataaatactcagtatactaacaacagtcacacaggtacaacagttatgagcagatgaaccagattcagaaagaaatcagtcaaaaagagaaacgaataattgtgtgcacccagctttatatctgccatcatctgaaatactatgaaggacagcctaagtctttatgagatcagtcaagtttggatggatcaccatcacatgtgcagtcacccaaaaagccaagatctcgagaaattttatttttcacaaatgaagatgttcaaaaagaacatcattccatttattgaggaagtttcaacatttttacatacacgtacaatgcttacacacaaagtcaacattgtgataatgcactttcgtgggtcaaatttgtaaaaccctgcataaaacaaattagaagtctttaaaagtctttacacaatttataccctagtactggaaatgatgtgaagatgaaatacacagcatagtgaattaatactatgtgtggatggatgaaactcatatacaattgagtaatttggcatgagagaattcttgtatttttcacctgcattttcactttttctatgatctttaaaacactcactgcacttgaatttggagagtgtctacaaattctggaagtatatgctgtccacttgaaagtctgtttattggctcatctcttgtaattgagcaattttccgcttccaggcaccaataattattagcttttaagccttatatttcaccattaagtaacctcatgtgcttgaattatcatagtcttttggtgaggaaattttacagatctcttccatcatgtaacaaggaatacagttaaaaaaaaaatgcatctgtggtcccagctacttggaaggctgaggtgggaggatcccttgagcccaggagtttgagcctgcagtaagctatgatcgcaccactacactccagcctgggtgacatagcgagatcccgtctcaaaaaataaataaataataaacaatgatattcatcatcctccaataccaaatttttattagtctccagagagactgttagggttctccagagagacagaatcaataggatatccatatagatatatgagagggtgtcgtgagcagtgcaaggtcaaacataatcacaaccttgcacctttgtgtctttttataagattagactttcattgatgttattttaattataaaagccacacaccatatggagtttccaaggaggcgattttctttagtactctccatttacttggtagccaaagttgtgcgcatgtggactcaagccaccttactagttagttaataacataaaccatgcataaaattatacttaatcaatataaatgttttagattaaatatttcacatcaaacaaaataacatcaagagaaaaagggatagaaaaaaatgggttaatgaacaagttcagggaaagtgacgtagacaaagagaatgtccaggcctagtctggatagtctgttaatgtcttgtaaggaagtgtctttgatatggacagagcctttggcagcagaggatgggtgtttattataagtgacagtaagatggtgtctgttaagacggccatttcaagctgctggagttatggccacagagtcctctggtgaggactgatagtaaagagtatgtttggttatgtccttatttggttggatgtagcctttactgattaggcaaaatatttgatcctcattgacaggacgtcttttaaaatgtaagatggagtctttttctaagatagaattacttatgtcaagcagattctataaagaagagatttattagggaaattggctcacgtaattacagaccatctgtaagctggagaccctggaagaaccagggaagcagacaatggtgtaaccctcagtctcaggatgaagcctcaggacccgaggcaccactggtgtaagtcctggagtccaaaggctggtgagcctgaagttctgctgtccaagaaagtggaagaaaagtctgtcccagctcccagagacagaccagttcactttttgtatttgttctttccagacccctaaccaactggatggtgaccaccaccactgagggcagatcctccccacctagtccactcaggcatgcgcactgacctcctctggacacacccaaaataatgctttcccagatttctaggtattctttcattcagtcaagctgatatctagaattaactccacaaatctaccctttgtcaatatggcactctttaaaccttagtacatttccaaataaagacaataataaggtcctagttcccctaacaagatgcaactatcccaagtacaaccaaaaacacactaatcccttccccaaaatttgacttccaggattgcaacattagggattttatctttagggatagtgatttacagaattttagacttaattttgatcaagtgattttgatcttttgggattttcatcttttgatatttttagcattcaagattatggcattcaggattgtgtctttcaggattatggttggcaccaggacaatataatttgtggataggtgcttgcaaataccatactcaggtattcatctttttaaaacattttaaatttataaaaaaaaagatataaattttaaaatttcttaacttaaaactttttaaatttcttaaaaatgtcattaaataattttaatataaaaacaaataaattgttcttttgaaatgtatagcagaaatttcaaatatgtcataacagtttttgtctttttttgatgttgagtatgtcaattagatttcagtctgatttttgttgttgttactgttgttgttgtggagatagagtcttactctgtcacccagagtgatgccatcacagttcactgtaacccaaaactcctgggcacgagcaatcctcccgtctcaggttccagagtaactgggactactggcacacaccaccatgcctggctattttacttttttgcagagacaggggtctcatttcattgcccagatggtctcaaactcctggcttgaagcaatcttctcaccttggcttcccaatctgctgggcttacaggcatgagctactgttcccagacccagtctactttttaatatatgttaagtcactaaattttaagtaatatcatattatgtttgtggacaaatcattttttcatatttaaattaaattaaattaaatagcatcatgggtcacttgataaatgggggaattttgaaatttacttcatcttatgaatattatcaaatgttacattaaataaactttataaatataattttaacaatatggtgatattgttttatctaaacttatttataaatcacttcacaaaaataatgaagtaattataaaaattttataaaggaggtctgtgagattatgtactacttcgaaaggaattcattaattaaaaatgttgggaaactgttctaatctacttgaactctatcccaaagagttccagtgtacacagtggttataatattaaaggaacagcacacctgctgggcgtctaacactaacctcttgttttcttaccacaattcttttttatcttctataacattttacaactaagtgttaatacacacatgcacatacacccacactcagacaattgaagaaaataatattcacagtcctccccattaaaatgtatgtgcacccaagtaagtaaaaataacctcctggatttttttaagaaataaggcttccagaaaatcttttaaaacttaaaaccatagctatagaaatgatttgtgctgcaagtatttaagcacacaaggtcagccttgattggcagttagaattttacatacctcaaaatgtgtatgatttcaattaagttctaaatcactttaggtgaaagtatgcaaagaaaattattttcctcctggagaataacagggacttaacttggctccctgaggtctatacaaagcacttaatctcttttcctcagtttctagctgggaattacatctctacaacatagagatgggatgaccaaataatctaacatctataccaagctttgaagtttagtaaaacggatgtgctggttgggtagcagtgctattgttttcattgtgtttcattactttcataacccagggtttccattgatgaaagcctacaacaaagcattcatggtgtgtgtgtgtgtttcaaactgccacattagtgactggctgtgtatacacacaaaacatctatgtattcattggtaaattagtatgaagtgtttattatttaataatttaaataaaaattttttcaacctttccattcttttaacttttcttcagagtcaccagaattatttcactaatacagatcagaagtgctcttaaagcacacaccctccattagatagcaacatttatttcacagacctaattttgacctaaaaaataaaattttatagcctacaaaatgaataagtcatcgagaagagctgatacttaaaatatgtacacatgatgagatcaaagattgccaaatcaatgtgacttcttaaaatcctggaaaaatgagagcaagacatctcattgacatctattagaagtaccttagtaaattaaaacatttttatcttcccctttctttgtcaatttctatttgagtaatataaaggcttatgttctcaactggagccaaagaaacacctattaccattgaggtttagataatttttttacaatttttcataggacctacacagagtccttatctgcaaaaaataagatgtgaattttataaaatgcatttgccacacaaataaggattcattttaaaacactaatctatttaaagtgacactactttttctttcctacattaaatttattctgaaagtgttaaattaataataattaaaagtgttttagttagaaataacaaccatttatgagaaatgacaataaaataatacgaaggatgttgaaagtagtctacatatccacagaaatgcagtctcactgatgtaatcttattaggaaactatacacatcttcaaatgatatactgtgacatagttttgtagctattgctttatgtgtattcattgttcattatatgctaaatgctgaaacatgaatgaatgaacagatgaatggattgcctcagagaccatgtgatatttttaacatcaaaaatggtgataaatatttattcttcaagaataagttcagaaatgacaagaccattaaaagcaaactctgatgaataataaagctaatcaggatttggtgaatggtagagaaaaaagtgttcatttgtttagcatctactatgtgcttgccacatagtaaaactgctggtttccaatcctctttttctgcctaaaaccccaaatttagtttttttcccctttcccctgctaactaaaacaaagcaaagtcaaccccattcccagatcccgggctagatcctcataaatctaagccaatcagtacacatggaattaccctaggagctcttattgggtgagaagtgggcatgtcattttggcccaattagactgacaaaaaagatttctattccctgatcaggagatttttctcttcctctctctgaacatgaaaaaagaggcctgtttttgcccgtttctagcagtctttgacaggttggttttcctgaagtcatgagggaaatcagcctgaggttaaaggaataaacacagctaatggcagggtccagagaatatcagagaagcagagctggagtcctcatataacatggctggtgcccaccaaatctctgaacttcttgatgtgaagaataatacttttcctatttttaagctagtttgagtagagtttttctttcccttgaaaaaagcatcttaactgaaagaataagaacaataacactaatcatttgagaaattaccatttgccagatattgcagcaaaaattaaaattcctaattctcaatatagctctgctctaattttcatttaattgatgaggaaaatgagtttaaagaaactaagtgctttacctcaaaaatatatgtatatatattttaccaattttaaagtaatttaaaaaatatattaatacagttttttttaaatgaggtaccttattcacaatatcttgttatcagtgagtgaattatgattagaatctgggatcctctagctttaaaactcgtgcaaagtactttatgcatcttcacatttgatgttcaccacagccctacaatgtactatcatcaacaccttagaaataaagcatcttgtgcaagttagtaattaatttggctgttaataatggaaaaccaactacagtggtttaaccatacaaatgtttattcttacatataaaaggaattttgtactacacaattctgtgctagtaaggtggcttcacaaaattataactaaccaagctccttctatcatactattccatcatcctaatccaagggctactacacacaaagtctcctcatggttcataattgctgctgaagttccagtcatcaagaccatactccagtcagtaaagcaaaagatacttcttctagatgaattcactttcttagtcacattgcctcacttaactacaagggaggctggaaaatttgttattttatctgatgtcttgctgtttcaaataaaattatgattctgtaactaagaatgaaaaataaaatgaatattggtaagatagaaatctttgccttagcataagaaccttaaggaagtaataagacttgcataaggttatacaactaggaagggtagtgactcagtatgtgaactatggctgtagaattccaaaactcaagttcctaatttttatgctgcatttcctccctaagtagatgcatgagttatacagcataaagaaatggcaccacatgataaaacaaaaattaaaaatgatgttaggtattcatttgtgagttaaaaattagactcattactttagagttatacttttagtatgtgtaaaatttactgacataaaataaatggtatatagcaaagttaatctaatataatttaatgacagcattatcattgatatgttggcttctgtagataaacaggtatgccctttaagcactacatttacaagcttatcatcatattttaaattgtcaattaatttagccctctgtagaattatgctattcaccctatattcctaactcatagagcagcatgaattagattctttattcaaatgatgtataagcattattaaaatgtatttctgttgtgctgaaggaaaggaaaatgcatgtgaggacagaattaaaagagcagaatgcctagattccagtcccgacttcacccccagctcactctgtgatcctaaatggaggcaatttgggcctccatttctgcattttttttttgaaagacatctgagtttcttttattataaaattcccaaatcctcatgttcaatgaaagtaagatctataccttagcttttggataggaagaagtaggcaaagacctaaagaggaaaaaaaaataaaattaaaaaataaaatcctaggctttctctgctcaaattatggtttaacagaacctgtggaaatagactgaaatagactatttgggctccctgtgtgttctggtatacatcattaacctggcatttctctgaatgcagaagagaaaatggccctctttgcaaaactatgtttcagagttctgaatttgatagtcttattgattgtaagtagaatttatacaagttctatttattatctcatctatgcctaaaattgaaggaaccaattccaactggtaatcaaatactgggaattcataaaaaacaaattaggtagctctacattacaactaatattgaaagaagtccaatacatattgttaaataaaataaaattaaggtgcagaacagagggtatagtctaaaggcattgccacaaaaaagtatatttttaaaagtatatgttaactatagtatatattaaaagtaagtatatattagctgggcatggtggctcacgcctgtaatcccagcactttgggatgctgaggcaggcggatcacgaggtcaggagatcgagaccatcctagccaacatggtgaaaccccgtgtctactaaaactacaaaaattagctgggcgtgttggcacgtgcctgtaattccggctactcaggaggctgaggcaagagaatcgcttgaaccaaggagtctgaggttgcagtgagccgagattgcaccacagcactcaaacctgaccacagagcaagactccgtctcaaaaagaaaaaaaaaaaaagtttatattaaaaaataaaagtgtgtggcctggcgtggtggctcacacctgtaatcccagcactttgggaggccgaggtgggccgatcatgaggtcagcagatcgagaccatcctggctaacacggtgaaaccctatctctactaaaaaaatacaaaaaattagccgagcgtgatggcgggcgcctgtagtcccagctactcgggaagctgagactggagaatggcatgaacctgagaggcagagtttgcagtgagccgagatcgcgccactgcactccagcctgggagacagcaagactctgcctcaaaaaataataataataaaataattttaaaaagtgtgttcatgtaaatacacacacacactttgcaatgtgtgcacatattgtgtgtatctatatatttctgtttcattttcggtttctaaatctgccaaatttccaatcttgtttagtttcttgaacataaacatagatattttaaatttagtttctggtatctacatgatctatatcccctctacatgtgtgtatatatatatatacacacacttatatataagcagcatatgtacacatatgtgtgtatgtgtatatgtatgtgtatatatacacatacatacacacatacattgtcatataatttgggaaagcttaaagcaattatcttttcaaaaagtgtttctcatccttctagagtcagacattttcaacacatttcactgttgcttctggctcttttctgtatttttcattgtttataatgtaaatatttaaatattttcttctgatctatcttccagttcactaattctctattcagctttatgtaatctcctgttaaatctatttatttagttctttatttcatttattgtatttttttacttctaaaatttctgtttctttttcagtttctaaatctgccaaatttccaatcttgtttagtttcttcaacataaacatagatattttaaatttagtttctggtatctatatgatctatatcccctctaaatttgtttctgttatctgttcctttcccctggcttctactcacatgatcatatctccttgtatgcctcccttttttttgaatgctgaaaattatttataaaaaattatggtgctaatattaggctctagagattgtaatctttgtcctgaaataattacttgcttcagacagacaggtatgctagagtcactagcaaccacaaataacctcaatccaatcaagaattaggataatttaaagctgggtcttctccctggaagtgctgattgattctaaatttattgtcattcctagaatgtaatcattctgaatcctactccaaagcttcagagagttaccatgttttcttttccaacatgaaaaagaaacacaaatagatacattggtccagaggaacacaaattggagtgcaatttggactacaatttgtgttcctctggcctatgtatctactgaagcacactttcagaattgatggcacctctagggattgaagtgtctccaaatgccaagttcaattctatggcatttttcttctccagggtcttggctgcacaatctctcaccatcttggtagctttccaatgccttaagagaattttcaaaatttttccagcttctgtagttgtttggagtgggagggtttgtccaagctacctagcttgcaatttccagagacagaaatcctatatatgttttttaaaatacatataaatatctgggaggatatatgagaaagtatataaatgtgcttacctcttaggagagagagagaaatttgggtaaggaaacttttcacttttagcatacaacctttcatatacagttagaatttctttttcttataagtatgcattgcttttattttaaaaatctagtttataaaattattcaataaaagtttaaaaataaaaatagtaatcaaataacaataactttgtgacaattatttaatattcactacatggaaggattatcagaaagcctacctaaactacaggttggaagatatgtctgtctattaatctgatttgcaatctacatcacatagctaaaaaatacacttctataaaggaagagaacacatggaaaaaaataagtcaaagaaggcaaaaaggaatcagcaatatttagccattgtatttgagatcttaaagtttattatttatgtgtcctgttatttgcaattaataaacataattatcttcaattgttagacaatatatgtaataatatatacagcggtttctaatcactaaattaacatttttaaactagaatatctgttttcagggcaaaatataaagcatagagactttccaaaattagtatgtgacttaaaagacatgcaaaagtgctccctataaatattaacttgcttatgccacaagtatgtactcaacactatttgacagtgctaatagacccaagcattcagtcatttggcaaagccaacaaagactatggcttaaatgggtctgaatgattggaagaaccattgttctgcagtttccctcagttgtgatatccgacccttgtgcaataagtcccacagaaggaaaatattgacaaaagaaaaaaatagcaacataaattttaaactcaagctaatggcattttcattgtgagctacaggttacatcctaattcagtgaaactataactttgcaaatattcattgtctattgacaagtttgaactagaaattgatttcaaaatggaaaaacataggggcatgtggaagatgtctagtttacagtgatacatagaacatttacaaaagatatatgaactactcatattttgcttctgtgaactgaacacttcatttatccttttcagctctatgagtgaacaacttgttccttaggagaaaaaaaaaagtaaagctgaatgtttttgaaaaatctttcagatctctactcatatccagtttatttaagttacataatcccatctcaataccctgcaggccataatcatcaagtaaatcacatcacgggcacctcctataaaagagaaaggaaagggatgtaaggaaatgcacacatgtatgtgtctatgtgtgtatatctatgtataccaaaccaaagaagaaaatgtaatagtcatgataacacagttgatactccacaattttataaatccccttctccacttgctccatgttcctttattgtaagctatattccttgttcagaatcaatgttaattgagattaccaggacagtgcatgatgtcagaagtttggcaagcagggaaggcaagtgcatatcttaaacaagtgttttttcccatgaatataagtccttcagacagaaggcatctaatattattcaccttctgccagagtgtgatgccctactaaggaccagctttgatatttgctattgatatgttgtgcattaataaaaagcagtagcttgatcaactatggtgatgataaaattaggttttaagcccccattcttcccaccatggccacgttgttcatgagcacattaagcaagctttgaggtagctattacctaggctgacaaacacctgcagagcaggtcattttgtgcaccagactgttgagaacctcttctgcaagattttatgttgattattaatttggaacacaaatatttgcccattttaagaagactatcacactcctcttccccaaactttcttttcatctgttccgactgtgttatcttcgaagtccctagccatttgaccaaaccactgatcattatctaagaatcagtggagcttcaatacaaaagcgaaatctctttccaggcaaatggataagcagatacaactgtccatgccctttacgtggaagattttgcttcctcaataaacttcagcagcaggaaggggtgtataaggccacagttagtctatttccaattagtgttggcagatcatgcatgactactcaactggccttaggaaacatcccattaggaatgagtatagattgaagaaggctgtgaaggagtagacgcactgggcattgtgaaccacctgctctttgaataaatttgtgctttcagggcctgctctagtcacgtgatgatggagtcctgccatcaagctcaggtaacgggggggttcacaatggcttttgcttctaaatcaaaaaatctttgcattggtggaatcatgcactcttctatatctttcaataacactgtttatacaaatatctaaaaattataagtggttgaattttgcacagctcacatagctttgtctatcatacagtcagaacttagtattccactaaaaatcgtagttctttacccattagtctatatcttagtgtattagtcttatctgcttttattcagctgtaacattcactatccaatatattattagatttttaaaacagttctcagacgtaggttgattttattttctcattatttatctacacagtttattttctataggtcatatacttcactgtttattataaatttatttattcttattccagtattgcattctcctccttatcatgttttttgttgttgctgttctgtgagatacttctcagcatatgccaagtgttggtttggtgttaaatacccacattgattttgattctatttttagcaatttggctacttaaataacacttctagattgtgtaaagcaacattttatctttcgcaacatactttgtggatctgacctcggttcttactaacactaaatctaggaggtaaggtgggcagagaaggtttttctttcttactttcttcctttctttctttctttctttctttctctttcttctttctttctttcttctttctttctctttatttttacattttttatattaataggctacttttaaaaacagttttaggtttatagaaaaattgagcagatagtatagagttcccctattccactctcccttacacagtctcctattattaacacgttgcattaatgtggtatgcttgttacaaacgatgaaccaatgtaggtaggttattctgacctaaagtccgtaatttactttttttttatttttttattttttttactatttctattgtttaagttccatggcttttgacaaatgtataatgtcatgtatccaccatacagaataatgctgccaacctgaacctcccctgggcttcacctattcatccctctccctccccactaactctggcagtcactgatctttttattggctctatagtttttcctttttcataagtcatatagttggaatcatacagtatgcagtctttccataatgtcttctttcacctgaaatatgcatttaagatttcaccgtgtcttttcatggcttggtagccaactgatttttatagctgaataatattcccttgtataggtgtaccacagtttatctatacattcatctactgagagacattttggttgcttccagtttggggcaactattaataaacctgctataaacatctgtgtgcaggtttttatgtggatgtaagttttcaactcatttggggaaatacctaaaagtgtgattggtagatcatgtggtaagacaaagttaaacttagtaaaaaataaataaaaataaaggggccgggagcagtggctcacacctgtaatcccagcactttggaaggctgaggcgagcggatcatgaggtcaagagactgagaccatcctggccaacatggtgaaaccctgtctctactaaatatacaaaaattagctgggcatagtggcccacacctgtagtcccagctactcaggaggctgaggcaggagaattgcttgaacccgagagatggaggttgcagtgagccgagatcgtgccactgcactccagcctactgacagagctagactctgtttcacaaaaataaataaaataaaataaaataaaataaaataaaataaaacaaaataaaataaaataaaataattttaaaaactggcaaactgtcttccaaaaggttgaacaagtaatgaatgagagtttctgttgttccatagcctcaacagcctttgttgttgtcaatgctttggattttagccattctaataggtatgtatagtggtatctcattcttgtcttaacttgcatttccctgatgatatgatcttcagcatcttttttatgtttagttgccatatcctcttttgtaaggtgcctgttcaaatcttatgccaatttcttaattgacttttttattttcttattgatgagttttaatagttctttgtgcattttgaatacaagttctttttttttttttttttttttttgagacagtcttactctgtcacgcaggctggagtgcagtggcacaatcttggctcactgcaacctctgcctcccaggttcaagcaattctcctgcctcagcctcccaagtagctgggactacagaaacccgccactgcactggctaatttttttttttttttttttttttttggtatagacagggtttcactgtgttggccaggctggtctcgaaatccggacttcatgatcctcccgcctcggcctcccaaagtgctgagattacaggtgtgagccaccacgcctgcgtgaatacaagttctttatcagatatgtgttgccaatattttccctcaatttgtgactggtctttccattctctgaaatgtgcttgattttttttttttttttttagatgaagttttgctcttgttgcccaggctgaagtgcagtggcacaatctcggctcactgcaaccttcgcctcccaggttcaagtgattctactgcctcagcctcctgagtagctgggattacaggtgaacacccagctaattttttgtatttttagtagaggcaaggtttcatcatattgtccagtctggtctcaaactcctgacctcaggtgatccaccctccttggcttcccaaagtgctaggattacaggcacgagccactgcgcctggccatgtccatttaattttgtttctgtcacttgcaaatgaaagaattctggctaatagatctttgtagactttcattaatatataaaatatattttaaaattgtatcggaacttgaccattgaagatcatctgtcaatccaaggatatgtatgttgctgtcattaattagtgagtcctgtagataagacccacaagggattagcctgagtaagctatccctaaccttctgaacctttcattcaggcagatttagcaataaaaaaaaagaaaaaaaaaactttataggaaatatatactttacaatacctgaagaagcatctccattttcttttcacagttctgtttcattttggcaacttgtgacgaagaacctctaagcctaaaaattataaagaaaaaaatgggataatgaaaataattaatgatataaatattaatattacttatagaatatttttaaactccaacaaattaacggctctcaattttccatttgcttttatgtttatcaaaatgcaaagggacaaagttgttgatatgccatgttgtataattgatttatgtatagaagtaattcatgatagtcaaaattaaaatattatgccttgatatagcagtgctcattagagtaaaatcacgctaggttatagaaacgtcttttcaatttacagtgtaaggttattccaacaacataaaaatagaatttaattgaatttgggtagaattatttccaacatatgtatgagatgaattcaagattgggagcagggggtgtaaaacaaatgtttcttcaaagatgttttccttccagtctaaatggtngcaacattaaacctgccctctgcaaattgtgccatctggtcctcaccagaagagtccgtgactatgtggcttccatcggtccaaggcagggctggccttctccccttcacgctgattttctggtttgaggacccgtgctctgaggcgtataaactgctttacttcccctattaagacgttgacatgaatccaaagcggtatccttgcagtagtgaagaaaggcttcaaaattgaaatgaaccacccttgcagtttaatgctcttgtcatgtagggtttcttcctttccttcctttcttctgtccttttttcctttcttaattttttttttaaataaagactacaaacagcaggggatatacagaccttgcaatcgctagaaaatgaaatgtttccacagcattgagatgcatttagtgctaagacgaaaatttagttccttctattcttttgtaaggagaaagtcttctttgaaacaaaaatgaaatagaaataatttcagggtgatgggacatccccagccttcaggtcatgctgctctctcatcattttttaggttgcttggtgataaaagaaaaggaaaaaaagagaaaattccctaatcagagtttcatcaactgagtgatcaacaagagaaaatggccacttttatattcattaaagtaacttttcaaagaggagagatttcagaattagtgacactgagtgcatattgctaaatttattgttgaccgttacttggaaatttttgtttgatctttctttgctttcttctgtggtgtagcttcattatatatatatggttgcatctttcttttaagttcactctgacaatttagtttccttatgtttcgttgttctgggaatcacattcaaaagaaattaaggctttttttaattcaaaaaaagcaataaatctttcaacaaataacataaatttttaattaaaaaataaaaacagctacatgcattatatgtatataaaacatttctttatttgatctttctccaatgataacagtattataagattgttacaaacaattaaaatagtgtaatataaaaaggtagaggtgcagaaataattttgtgtatactccccacttcaccccccatctaccaccatctcaccccgctgagttaaccgatgttggccatctttgatatatccttttatgctgctatgtttacatattctttataccatacatagagatttgaaggtaatactttaagtgaaaaataatcatatcatatgggttttttgcaaattgtgttatttattttgaaaatatgtcatagaagatttgtatgatgaatttttttaactttttattacagaaaatttcaaatatatacaaaagtaggaagacttgtaaaattaacccccatgtacccatcaaccagcttaaacaatgatcaactaaaagacaatatcttttgcatcttaccctccctactcaattattgtgacacaaatttagatatcatgccacatcaatcataaatatttaaggtgcncctattaatngaaatgatgaatattttagtacaaccataatactttttaacaatctaaaaattaatagccagccagtattcaaacgtccagttttctcataaatgaagtcttatggtgctacagaatgtctcacaatatggatttttttggtcaggaataactcacaggtggatttgtatatatctccagaatgcacatgtctgctagtctctttttttgtgatattagcagccattgataatcattgcctacttctattaatttattagtggttgcaaaattgtaatagtctaatgatacaactttttcttgattcattgcctggaatatttctataaaaagaaaaggcctttaatcaacaagtttcttactctgaggaggagttcatataggaaagagagaacaaatgcttaaatatttccctttgcttacctcttttcaaaataatgaataagatttcttataccctccaaaaatatccaatgatttctaagtataaatataaatttatggatgtaaacatatttggtatgtctcaatccagtgtgtttattaccttttatgttgtttaaatggtcatatcttttgccacagacttttgagcccatttttataccctctggatggctattttaccttcttaaaacaagttatgccagctttagcatttgacaaaatgcaacatccttacatgattaagaaaaaaaaactgaacaaattaggtataaaaagaatgcacttcaagataatgaagaacatatatgctgaacccatagctaatattacactcaatggtgaaaagcagaaagttttttctctaagaataggaacaagacaaagattcccacactcactgcttctattgaatatagtattggaagtcctagccagagcaattaggcaaagaaagaagaaagagagagcataacaattagaaagaagtaaaattttctctgcttgcagttgatatggtcttatatctagaaaatcctaaagatttcaccaaaaaaaaaacctaaaactgtcaaaactaataaacaaatttaataaagttgtaggatgagctttatttgtattgatcaacaaaatcaatacacaaatcagttacatttctatacaccaacaacaaactatctgaaaaaataaatgaagaaaacaaacagaaaaccaaacgccacatgttctcactcataagtgggagctgaacaatgagaagacaaggacacagggaggggaacatcacacaccggggcctgtcaggtggtggggggcaaggggagagagagcattaggacaaatacctaatgcatgcagggcttaaaacctagatgatgggttgataggtgcagcaaaccaccatggcacatgtatatccatgtaacaaacctgtacgtttagcacatgtatcccagaacttaaaaaaaaaaaaatgttgataggggtgaaactcagagaaaaaaaggaaggggagaatcatgggacccatcccagcagggtgggaatcattagattattattaggaaatggaatgaggtaaatggaaatttattatgtaaaataaaggccttaatacagtatcaaaggttgagtggaccaaagagagcccctgctgcttccccagtattagagagacccaagccaattttctatatttaccccagattggagaaattttttttaaaaaaatcagaaagcaaagttacaataaggaaaaaaaaaaaggacaggccaggcacggtggctcacgccagtaatcccagaactttgggaggccgaggcgggcggatcatgtggtcaggagttagagaccagcctggccaacatagtgaaacaccgtctctactaaaaaaacaaaaattagccgggcatggtggtgcacgcctatagtcccagctacttgggaggctgaggcaggagaatcgcttgaacctgggaggcaaatgttgtggtgagcagagattgcaccactgcactccaacctgaaaaacagagtgagacttcagcaaaaagaaagaaaagaaaagaaaataaaagaaaagaaaagaaaagaaaagaaaagaaaagaaagaaaaggaaaggaaaggaaaagaaaagaaaaaggataaaatacttagtaataaattaatcaaggaagtgaggagtctgttcactgaaaaccacaaaatatcaagaaaagaaattttaaaagacccagaaaaatgaaaagatatgccatgttcatgaattgaaagaatcagtattgttaaaatagacatactccctaaagcgatctacacattcaatgcaatctctatcagaattccaatgttattttttggagaaacagagaaaaaactcctaaaattcatgtggaaccacaaaagaccccaaatagccaaagcagtcttgaacaaaatgaacaaagctgaagacgttatacttaatgatttcaaattatagtagaaagctatagtaataaaaacaccatggtactggcataaaaacagacacatagaccaatggtacagaattgagagcctgaaaataaacccacacatatacagtcaactaatgtttgacaagggtgcccagaatacaaaatgaagaaaagacaacctcttcaataaatagtattgggaaaactagatatccacatgcaaaataaaacccggccattgtgttatgccatacacaaaaaatcaactcaaaatggattaaaggcttcagtgtaaggtgtgacaaaaataaaacttctagaagaagacaggggaaaagttctttgattcatcttagcaatggatttttagataagacactgaaagcacaagctacaaatgcaggaataaacaagtgggattatatcaaaccagacagctcctgaatagcaaaggaaacaaccaacagaatgaaaagactccagcctgggcaacatggcaaaaccctgtctctactaaaaatacacaaaattagccaggcgtggtgcatgcctgtagtcaggtgcatgcctgtagtctcagctactggggaggctgaggtgggataatcacctgagtctagtgtgttagtccattttcacactgctataaagtaataccaaagactgggtaatttttataaagtaaagagatttaattgactcacagttccatatgctaggaggcctcagaaaacttacaatcatggcagaaggtgaagggaaatcaagcaccttcttcacaaggcaacaggagagagagaaagagtgcatgaaaggggaagacccccacacttatcaaacaaacagctatcatgagaattcactcactatcatgcgtacagcataggagaaaccatccccatgatctgatcacctcccaccagtttcctcccttgacatgttgggattatggggattacaatttgagatgagatttgggtagggacacagagccaaaccttatcatctgggaagtcaagagtgcggtgagctgtgatcactccactctactccagcctagacaacaggagtgagaccctgtcttttaaaaaaagaaaaagaaaaagaaaatacaacaggatggaagaaaatatttgcaaactatacatctgataaggggttcatattcaaaatatataaagacctcaaacaatttcactgtaagaaaacagacaacctgattaaaaaatgggcaaaggacctaaaaagacatttctcaaaaggagacatgtgaatgagcaacagatatatgaacaggtactcagtatcactaaccatcaggaaaatgcaaaccaaaccataaggatataccatctcacacctattaggatgactaatattaacaaaacanaagataataagctttaatgaggatatgagagaaaggaaaccctgatacactgctagtgggaatgtaaattggtacagcctttaggaaacaaaaacagtaaggaggtttctcaaaatattaaaaatagaactaccatatgatccatcaaccccacttctgggtatttatccagaggaacttaaatcaggatcttgaagagatacctgcatgcccgtgtgttttgcagcatggacaggatatgcaaacaacctaaatttccactggtggacaaatggataaagaaaatgtggtatacacataaaatggaatattattcagcctttaaaaagaaggaaattgtccaggtgcagtggctcacacccgtaatcctagcactttgggaggccgaggtgggtggatcacctgaggtcaggagttcaagaccagcctggccaacatggcgaaaccctgtttctactaaaaaatccaaaaaaaaaaaaaaaaaattagctaggcatagtggtgcatgcctgtaatcccagctactcgggaggctgaggcaggataatcgcttgaacctggaaggtggaggttgcagtgagccaagatcacaccattgcactccagcctggacagcaagagggaaagtctatctcaagataaaagaaaaaaaaagagagagagagagaaggaaatcttgccatttgcaacagcatggatggacctggaggacattatgctaactgaaataagacaggcacagaaagacagatactaaatgtgtgatctcatttatatgtggagtccaaaatagtcaaattcatagaagcagagagtagaatggtggttaccagggactgagatgagggaaaactggggaggtgatggtcaaagggcacaaatttttatttatgcaaggtaagttcttgcatattgcttatagctaacaatacttaattgtacacttaaaatttgctgagagtataccttatgttaagtgttctcaacaaagaagaaagcaataacaataataacaaaggtggcaagaggaaactttgggaggcaattaatatatttatggctgaatgggcacggtggctcacgcctgcgatcctagcactttgggaggccgaggagagtgggtcacctcaagtcaggtgctcgagaccagcctggacaatgtggtgaaaccccatctctactaaaaatatgaaaattagctgggcatggtggcgggcgtctgtaatcccagctactcaggaggctgaggcaggagaatcgcttgagcccaggaggtggaggttgcagtgagctgaatcataccacctcactccagcctgggcaaaacagcaaaactccatctcaaaaaacaaaaacaatatgttaatagccttgatggtgatgatggtttcatgggtgtatacttatcctcaaactcatcgagttgtatacattaaatgtgtacagtttttcacataataagcattaagtaaatgtaaactagtattattaatttcaatgtgctctttacacattcctactattgtgctttttctttcaacattagaattcttaactttgcaagtttatatttttattatatccacctcaatcctttctcagtcaaacttaaatctacatatatttgtgcaaagacttttgtcatagaattgtattaagtgccttatgaaatatacaataattatatcatgaaaaagatggtgggttgaacacctgtatctactttgatccctcctgaaacttcactaaaataagaataaaaagattttctttaatgaacaaaccaacaaaactgtaaagaacaggaaaggaagcaagaaaaacaagatttcagaagctggaaagcagacagacgagtgagtagcaaatcaaaggatttatcagagagagatgtaatttacaccagaaaatacccagagcttctgtcaccccacctttccatatgaaaaggcaaggaggatcatcagacatctgaggaaaagccgctaacctgacagataaagacaaaaccaaacaaacaagagaacaactccatggaagcagacacaatgtaggggaagaaacgttattaaaaagcaaaaactatcaatgatatcctccaataaattagagaaaacattgtagccatgtaaggagaatggaatgctctttaaaaagtgattctgaaaacaaaaagcataggtctcaagctcttggaaattgaaattctgtttgcagaaattacatgtattctatagaagagaaggaagataggcctcacagaaagtaaagcaaaaatgaaggacatggaaaataagagtaaaaatataagaaaaagagagaggactagtccaagaggccctaaaagggagagccaacaaacagggagaaggatatcatccacaaacatactcaagggaatttcagaaaattgaagcatatgacttcaaagtacagaatccactaaatgcccctcacagtggataaaatagatgctacgagaaaaaagaaaatcctcagatttctgctgatcactgagagataagagctttttgagagaaaaacagatcacatgaaatgaaccataaacctgaatggcttcaggcttcctaacagctacacttaaagcaggattacagtgaagcaattcctttaaacttctgaagggaacatgtttcatacctagaattccacccccagtccaactacagatcaagtcagaaggccaggatagacatttccagacaaataacatctctgaaattttaccttgctttcaacctatctatgaaaactactggaggatacatgccacaaaaattaaggagtaacacaggaaaaatgaagaataaaatacagaaaacaggagatggcacatgaagagacgagggaggaataatgaaaaagagagaccaaggatggcagctgtgatctggcacacaagccaagcaggccagatgggcccagccccaagggctgtgatagatattttttcaagaagatgcaaacgggagaagatctgatccatcagaaggtcttcagactgtgattcatgcctcttgctgtcccttgtgtcactgactcctctagatgttcacattattaatttccccataccatgaaatttagactggccttgaagttgaattactgataaaaacagaaagaaggcaattattttcttcagagaaaacaaaacatacagattgggaaaaggaagacttacttaatacaatggctcagctttgaatagcatatacaattgtcatgttatggtaatataaacactgaattctgatgtaatcaaaactataggacaatgttgcaaggatgaagacatggaaagagtgcacggttatggtgacaataggaggaaatagaattcagtctctcacatctgcagaggcagatggaatacctcagctcaaagtcagaaacagcaagaaaatcatggaatttagagatatggaggtaaattctaaaatcagctaaagtaaatgaaagtgtttcctgccaagaagggaaatcagggtggggcagggcagagaggactggtatatttcataacataacttgtagaactatctagctctttgaactatatgtacatgtaattgcagtaaaagtaaaggaaaattgaaatcacttttatgaaaataggataactaaactgcattttacaattctctttcccaaatgagataaaaggtatttcttcaaaacttatttccataatttatttctttgtcaacttcttttatcattgatggagcctatcctgtcttcattaaagcaaaattagcattagtacagttcattcatttatttattcaatcaataaatagatatcaaggcatccttgccttaaaggagctcaccatacctcagggggaacattaaattacaaatcccccagctgcccgaggaaaagaatatcaaatgtgtcattagaggacaggacagggatagatttgcctgaaagtatctcagaaagttccacaaagggattttaaagacctgaaagaggagactaggtagatttttattttactttgtacattctcaaggtaattcagtgaaatgaatgttaaagagtatatctttgtgcatgtcactctactaaaggctataggaaacatgaagatgaatgaagataaggtctttactgctggcccaaaatataagagagtaaaataagcactaacgtaaaagttcagagagcttcaggggagtggacacagacagttgttccagagaagggatctggagctttgggaaagtgcagtttgagaggtgggacgtgattaagtgtctatctgttcattgacttccagaagcagaatacttgatttatctgttcactcataattctttccttcattcaactgccatatattaagtgcctactctgtaccagatactggactgggtctgagtatacaaggtgtacttgagcacaggcaaaggaagacatcacagagcaagtccaaagaaaggagacaagctggctgggctggtgtacaggagggagtggaagggaggacaggaagggaggagaggagagaggtggcaaggaaagatgactcataaaaatcaaagaaggcagggatgactacccttcatgtttaatttttcccaacttcctctaactcctaaattattgcctgcttttaggaaattttaaagcccttggaaaaaaattcgtaaaataaacctatgtagaagttagttggctcctctgggttccttgggtggaatataacctgacagcctgaatggtgctgtcccttggggcccttcccaggtcccaagcctgtggacccttatgtgatatcccaccactaccctgcccatcccttcactctctaagagcagaaatggagcagctcagtgttttggcggttcatttgtgttgtagcgtgtgtcggtacttcattcttttagtttctttttaagctgctttgttgaaatattaactcatgtaccatatgattcaaccatttaaagtgaaaagcttttaagtatactcacaaagttgtacaaccatgaccacaatcaattgtagaacactttcattgccccaaaaagaaacctcatacccattggcagtagtagtgtattctttttgtggccgagtgctattcccttgcacagatagatcatatttggtctatccatccatttattgatgaacatctgggttgcttcaaccttttggctattgtgaatagtgcttctatggacatttgtttgcaagtttccctggagacaggaaacagattggcagttgccagggacttgagaaatgggcagggggagtgactgacttactaagttcagggcttccttttgaggtgatgacaaattttctgaaatataactttgggattgcacagcatcgtgaacctacttaatgccactgaattgtgtactttaaaatagttaaaatagtaaatgtcatgttttgtgtatttgccataataatgctccctttttcttctgtcagaagtctcatttcctttgctcccactatctctcgcttgcccgggcagcttcctcttctctgcctttagtaaggtctttagtaaaggctgtactctcagcagcacttgtgtgtcacttaaaactgtagggagaaagtgcccaaaacaacttgttctaacaggagagtttaactgggtgacatattctgcagaaaatccccgtggacaattcagccattcccatctccatgtctgaacttctttcttcattttgactgctgaaatctttcacagcttctattaaaattgcctcttaaatataaatagctgcaatctcattccaattcattccatgatttcaggctcctaacatgcgcgcgcgcgcacacacacacacacacacacacacatatacacacacacacatatacggcgcttagagccccgcctgctctcctttctcttacttggagaagagaatattatctacagggctctgtgtgctacaaggcccacatatctcttccttgggatgaacaaagaggcagaggcccgattggcaagattcctaaggatgagagatttctcacatgtagccagcagaggttgaaggaagaggtccaagttaccttggtaatcaggagctgacagtgcctcagagctggcactgggcttgggactcctcccaccccacctctatctccagttttcttgagaagagtgacagtaaaggtaatctgttatctccctatttctcagtgtttgcctttatctgctgactgggcaagacttctttagtttctgaagaagttttgtggttgtttttcttagccacagcaggcaaggactgtgcctaataattagaacaagctagtgataagaattgcagaagggtctttaggaacttaacattaatgagtagatagatgattcttaactgtctgctacactcatataggcaaaatcatgtgaactttattttaatatctatggtaggattccaaacaaaaataaattctggccaggcacggtggctcaagcctgtaagctcaacactttgggaggccaaggtgggaggattccgtaagtccaggagtttaagaccagcctgggcaacatagagagaccccatctctatgaaaaaaaatttaaaaattagccagatgtggtggcacacggctgtagtcctagctactcagaaggctgaggtgggaggatcactcgagcttgggaggtcaaggctgcagtgagccacgattgtgccactgcactctagcttgggtaacaaagcaaaaccttgtctcaaaaaaaaattggccgggcaaggtggctcacacctgtaatcccatcactttgggaggccaaggcaggtggatcaggaggtcaggagatcgagatcatcctggctaacacagtgaaaccccatctctattaaaaatacaaaaaattagctgggcgtggtggcaggtgcctgtagtcccagctactcgggaggctgaggcaggagaatggcatgaacccgggtggcggagcttgcagtgagccgagatcgtgccactgcactacagcctgggcaacagagcgagactccatctcaaaaaaaaaaaaaatctaaaacagaaatctgaggtgctagcatttgatgtttgtgtgtctgcaagagagagaaaaggtgactattgcttataaatttacagattacttgggttgtttttattagtagaaaattttatctttagaaatagacaataaagtattttgacattttaaatttagtgagggccgggagcagtgttcatgcctgtaatcccggcactttgggaggccaaggagagaggatcacttgaggtcaggagtttgagaccagcctggtcaacatggtgaaactccatctctgttaaaaatacaaaaattagccagacgtggcggcgcgtgcctgtaatcccagctactcaggaggctgaggtgagaggatagcttgagcctgagagacggaggttgcagtgagccgagattatgcaactgcaatccagcctgggtggcagagcaagataactaactaactaaataaatacatacatacatacatacatacatttagtgaggagcaaatgtaagcactcagaatcctcaaagctgatttatttttatttatctctagggaaaacctaagaacacatgacatgaatttgactattcaccttaagttttacagtgaaagtttcgatttgcctcctatcctattacaaaattcagatactctctttgttttgtctttatttcctaagaaatgatttcttttgttcttaatggaagattccaaagatatatctcctgactcaatgttggcttacagacccttttagacaagcttgttttgtatcacaggaagttcttcagattctcaactagaagccaaatgagtcaccattttgtcttctgcatctttcaaatagaatttgtttttgaaataatagctttattgagatataatccacatattgtataattcatctttttaaaatgtacaatttaaaggtatttagtatattcacacagttgtgcaattgtcatcacaatcaattctggaattttggaatatttcatcaccttcaaaagaaacctcatacccattaagagtaactccccacctccccctcccccagttgctggcaaccactaatctcgtttctgtctccatggatttgtctattctagatagttttcataaatagaatcacaatatttgttcttttgtgtctgtcttctttcacttttcacaatattttcaaggttcatccatgttgtagcatatatcatcacttcattcccttctatggccagtgaatatggcattcccttctatggccagtgaatggatataccacattttatttatccatacattagttgatggacatttgggtcatttccatcatttagttattatgcaaagtgctactatgaacatatgtgtatgagttcttgtgtggatgtatgttttcagttctcttgtgttcacataaacattttaacttaatacagactagacttgagcctgaatgacttgggtgggtgtgtccatgcctggaaaggaagaggagagggaatcaaagaagagcgatatcagtaaggagacagaacttacttcactaatttcccaatttgcaaatccctctaaaataacaccacctgatatcataacattatagaaccacaattttacatatgaacaactgagaacccagaaaaggtaaataacttgttcaacaatttgttgaaaaccaactgggccaagggccaatggttcctatttcttagtaaacttccttttgcaccacctgcattgcattagtacacactgatatccaggtggtgtctaattagaaaaatttaagttgccaaggatcctatttaaaaaaaaaaagttgagaattggctaggattttcttcaattcaccaggaacagaaatatctctgttaatcaaagctaactcttatggaggtcttagtatgcactatgtactaagcagtgttttgcttaagctgccatatttaattttgaaaagcaccccattttacaaatgaaggaaccagatttaaaaaaaaaaaaaaagaagtcacgcagctttaatacatgatgaagtagcaagttgaagccagaagcatcagactctatgagatttggttatgaagtattttgctgtgctgacagatacagataaacatactctgtcctctgtctcctttcttttgtcctcccactgccactgttgttttcataggttatgagggttttgtttttgttttttcttgagaaggagtctcactctgtcgcccaggctggagtgcagtggcacaatctcggctcactgcaacctccgcttcctgggttcaagtgattctcgtgcctcagcctcctgagtagctgggattacagatgcccaccactatgcccagctaattttttgtgtttttagtagagatgggatttcaccatgttggccaggctggtctcaaactcctgacctcatgattcacccaccttggcctcccaaagtgctgggattataggcatgagccaccacgcctagcccacaggttatgagttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaggttatgagttttaaacaacctacaaatcggacatttgtaaactgggaatgtttatgaatttataattgtgctaagcaaaaatatgaaatcattccatgtataaataaaatcacatatatcctccaaaattgtcgacaaaaatgatatgttcttcatctcaggccaggatgacaaatgctttttgaacttaaatgcaaactccagtcaattgttagtggctcctagggtactgtgttgaaaatgattctaaagcctgaatgtttttaaaaattatcacatcaaggccacacattgccccactgtctggtcccactgacccacaagccaccaccccacagattggctcggctctggcctgagtcatatctggttcccccagccttgctgctataaagaaagggcttcaacagctctggctgaaggctgggctcaacttcatcaaagtatcccagggatcttcaaacttgaaacaattctgtctgcagaatgttccacatgacttcctgctgactggggtatcttcgagtacaaaactctccagactccagaacgtctgttcccttttgtggtcaaatggacctttcaaaggtttcccaaaccacttctcatgaaccagtgaatattcaaaagagagctagaaatttgaagcctgtacaaaaacttatccctataacatatgtgccataatatacaaacttacaccttttcagtccttcacatctacctctctgaattttcatgaatttctatttcacaagggtaattattttaggtacactggcagcagcatacaagcaaatatgtagtatgaaaacaattctcacaataaagtgagggcagcagaatttggttatgtgtatgttcttttttaatgacttttttttcgtagatatgaccacttgctttttcactttaaaaaataagattctgagaccaggcgtggtgtagctcacccctgtaatcccagcattttgggagaccgaggtgggggtatcacttgagctcgggagttcgagaccagcctgggcaatgtagcaaaaccccatctctactaaaacaaataaaaataaataacttttttttgaaagttgagtgtggtggtgcatgcctatagtccctgtagtcctgactacttgggagactaaggcaggagaatcccttgagcctgagagattggagctgcagtgagctatgatcgtgccactgcacaataatattaaaaaataagatcctgggctgggcatagcaacctttaacacctggagtagtagccactctggaggctgaggcagggagattgcttgagcccagcctgggcaacatagtgagacagcatctctaaaaaaaaacaaataataataataagattttattgatgcctcatttgggtcatattatagttaaataaggagaggcaacagaaaatcaagggttggaaatgccctcactttactgtgagaattgttatattagataagaattacttaaatagttgagtaacttcaatcttgataagagtgactaatgtagaggaaaattttttgggcatagcttggtaaccaaaggagttcatgagctagtatagtaattatattttccaaattcaaattggaacatacgacctcataataatttttaaaatgtataaatttattggtagaaaggtacttggcaaagatattaaaattaaatagcattcaaggatgttttaaataaatcacctttatagataaaatatagaactacagtatatttgctgataattctggaaaatacagtgttgttgatttaaataacaataaaaaagaatttggagttgctggtctctgatttctccaaagaaaagcttttatagctttccagacccaacatccttcctgaaattcactcacctccttctgcttctgtctgaaatccatataggagaggaaacacacatttctctccagattgaggtaatgttcttaagagcagactgtcagtcaggttctgagagttcaatttctagaggtacaaggaagccacttcctatattacctgtaattttagggtcattcacatggagattctgggctctcacccttttgcttgcctgaaatctacccttctaatcatttgcttaccctccaggggctgcttagtttcagcttgagtattctctggtgagtaggcaatctgctattttcatgaggggtctggaaattcttcactggagtatgaattcctccaaattccaggttcattgtccttgcttacgacctttagccccagttgaagacatttcccgcagttttctgcatttagcttcaggaccctctgccaagcccagtgctacaaagtctttttgacttgggcatccctagtcagctctatccctggattagtgtttttctctttttcctacaataaacatagaaatgggagccagtatattagctcagtgaaatctcaaggtaaacctactacgcttcctttattgcccatcaataatcctttcattttgtcatgttttcttgccttttcataccctgatagttatctgtacttaaaggttaaatcgagcttttccactcctcattttttccccttctattctttgatcctacattgaaatcataatgctggacttgtgacgtcactctcaattgtttccagatggcttatcagactgatcaaaaagaaggtgaagccaatatgttagttaaaaagtagatcttcaaacagggagatggttcagaaaaaaaaaattgtgtaataataatgttgagaacacaaaacaactataggtaaagtaaattgccttttctctctgtcctaaaataaaatctttgatcaattgttccagtgtatgaaaatttgaactctaaagagaccaggcagctttctaaacccaaacatcaaaagctttgcttccattagaaaaatttaaacccatgatactttgaatggatttgaaattctctaaaatgagctctaataataaccttcccaaacagaaagaaaaagaacagtaggttatatggcttcgtgctaccattttctctggaacattagttttccaaagatgccattttggctcgtaccaaataaaagggcaaaggttaccaaatgcaagcctagggaagccaggagacagaacagctattacaatggagggggaaatccaagctgtcagctctgaatggatagaaattgcatgtgtgaaattgacaaccagcaacagcatggtaccgtcagaggggccaggaaatgagctcgaccgggatttctgtttactgtattagagctgcggttttgtagagttttatttaagattcacagatacaaatcttcaggtttttgacaactttagtaatgttcagtggctgtttggaaaataatctaaacaaataaaatatcagaatgagaatggtagaactgatacaggaaaaaacataaataaagggaaaaaaatcaaccatcatccaacctcccaagagtctctgttaacaaactgttgcatttgcttcctcatacacacattgttatacaacattgaaaccaatttgtatatataactttgatttctgtttatttagtattatgtcacaaatatttttccatgtcatgaaaatgttttcataaccattgtgtttatagagcattctgtcacatgaatatacagactttaatttacttaaccataatcaattcaactactaactctttcccccaattttttgtcccattccagtatttttcccactgagcaactagagtgatctttcaaaaacttgatcttgtcactctcctttttaaaaccattcaataacttttctttctcttagaaaatattactgtccttagcaggccctttggagctttatgtccttgctacttcgatgtggttatgtccttcgtatcacctgggaatttgttagaaatatagaacctctactccctctctgaactactgaatcagagtctgaatttttacaagatcacaggtgatttctacccaagacaaggactgagaaggtctgctcttcactcttcatgctcctgtgttgcccccaccagcctcaccagccttctcaatgctttttaggatccagcagagacctagcttcagtgcctcactcaaccacgcccctttcctccacaaagccttgccaagtgtatggactaaatgtgtctgttcctccaaattcacatgttgaaaccctatccctcaatggaatggtatttggaaatggagcatttgggagctaattaggcttagattaggtcaagaggccagggtcctcatgatggaattagtgccctgtgagaagagacaccaaagggttctctctctctctttctcttccatgtgaggacatagagataaggtagctgtctacaagccaggaggagagtactctcaccagaacccgattatgctggtcccctgatcttccagcctctagaactgttagaaaataaatttctgttgtgtaagccacctatgctaccagattttgttatggcagcccaagatgacaaatacagcaggtacgtactatgctctctgcctggaaaggtcttctcaggactagtcaccaagttaacttccaattatccttcacagtccagttcaaaaagggaagcgagacttctcccacttcaggtcttcgataaatacatgttcacccaaaaccttgtatgcaaatgtgtagagtgggatgtctcccacttccctttttgagctgggctctgaaggataagcccagtgggaatatccagaatatataaagaacttttgcaattcagtaagcgacccaatttaaaaatgggcaaggacatgaatagacatgtctccaaagataaataaatgttctggaactagatagtaaagcacatgaaaagatgctcaatgccattagctatcaaggaaatgcaaatccaagccacaatgacataccctctggaccctgcaagatgcctacaatttaaaaataataactttgggaggccaaggcgggcagatcatgaggtcaggagatcgagaccatcctggctaacatggtgaaaccctgtctctactaaaaatacaaaaattagctgggcatgttggcgggtgcctgtagtcccagctactcgggaggctgaggcaggagaatggcgtgaacccgggaggcggagcttgcagtgagctgagatcgtgcctttgcactccagcctgggcaacagagcgagactccacctcaaataataataataataataataataataataataataataagcattcatgaggatatggagaaactggaaccctgatacattgcttgtgggaatataaaatgatacagccatggtggaaaacagtctgatggttcttcaacaagtcaaagataaaactgttatatgacccaataattcttctcctgggtaagtacccaagggtaacatatgcccccacaaaacctgtacacaaatgtgtagaacaatattatttattatagtcagaaggtagaaaaaaatccaatgtccatcaacagacagatggataaacaaactgtggcatatccataggatggaatattattcagtcataaacagaaatgaaatactaatacacactacagtgtggatgaaccttgaaacattatcctaagtgaagtaagccaggcacaaatgaccacatattccattccatttacatgaaatgtccagaacaggtaaattcatagacacagaaagcagattagtgcttgccagggggtgtggggaggggagaatgggaagtaaaatagctttataggtttggggttaccttttggggtgataaaaatgttctggaactagatagtgaagatggttatacaacataatgaatgtactaaatgtcaatgaattatacaattttaaatggctaaaatgataaattttgttatgcatatgtgtatactacaattaaaaaaagaagagaaggagaagcagaagtaaaaggaaagagaaacacacagaaacaaagagataaagacaaagaaaccaagataaaaggggactcttgggcgggcacagtggctcatgcctgtaatcccagcactttgggaggccaaggcaggtggatcacttgaggtcaggagtttgagaccagcctggccaatatgatgaaaccccatttctatctgggcatggtggcagatgcctgtaatcccagctacttgggaggctggggcaggagaatcgctggaacctgggaggcagaggttgcagtgaactgagattgtgccactgcactccagcctgggcaacaagagcaaaacttcacccaggaaatagaagagaagagaagagaagagaagagaagagaagagaagagaagagaagaagagaagagaagagaagagaagagaagagaagagaagagaagagaagagaagagaagagaagagaagagaagagaagagaagagaagagaagagaagcttatttattgtgagaacaaactacccagattttttttttttttttggacaactcttaatacttgattatacaggcaatcaggtcttctaaaactttcccagactcttccatgccaaaaagaagtgcttcttccaaactagtccctgggcacggacctactgtttatattcttcctccccaagaagattccactttccacatgccgtcacccaatttgtatgtttagttcacacttcgctgctgagcttggagatgggaattctaattcttcttggataattctactggaatacctcaccatcaattcttacttaacatattcacaattcctccccaaaaacaatccccatctaccactttactattgtacctgtttcaccagttatcttaatttacagaatctgaaacccaaggagtatgagtgagtttttaaagccacatagccagcttagtgcaatcccaactctgaaaggttgtagtcatctttcactcacttccttcatccaggatctcccgttagtcactaaattgtgttgatttttccttcaaatggtctttgtatccatctgcacccttccatccccactgccaacccccctgttcaggttttcaacacctcgcgcctcagtgcctgtgacagctcctggcaggcctctaaatccatcctgcacacaggcctcggtagcttgcctgaaactacagcatgtttgcacagaaaggatttgggagatcatcaaatctgttgcactaaacagagaaaatgccagagccaacacaaacctctacatgatgcctgggtccatgctgattccccaactactaagataggggaaaagaaggaataaaggatacatttcaagatagtcatgacccctcacagactgtcagcagggccagcctcaagcttaaaggaccagcaaggagtacagttctatagaatcacacaacagggtgcccaaagacaactcaagagttgtggttttaagagctctgcaagtggctgggtgcggtggctcacacctgtaatcccagcatttttagaggccgagatgggaggattacctgagcccaggagttcaagaccagcctgggcaacatgatgaaaccctgactctatcaaaaaaaaaaaaaaatatatacatatatatatacacacacacacatacaggaatgcactacaggtggtgcactcctgtagtcccagctacttgggagcctgaggtgggaggattgcttgagcctggaaggtggagcttgcagtgagctaagatcgtgccactgtactccagcttgggtgacagaacaagaccctgcctcaaaagaaaaaaaggaaaaagagctctgcaatctgggtgccatctgcacttctcccatcacattgggtctgcaacatcagaatgaagtaaatataggaattgcctgaaagtgaaggctcccaggattacttctggggaatctggaagccacacttcaatagtatgtggctgcctagcggagggtccttaagtgtagcagaagacattaaactggacctcgaagtgttctaacatcttcattttacagatgggaaaaccaaggcccagatatataaagtaactcacccaggctcactcaaacaactggtagcagcaaagaactaagattacctgcttcccaaattagtgagcatttacctttctattgtgctctatatcagtctctcataattagggcagtagtcccaatagagtaacaattgaaaaatatcaaagcagctctattatccacaatgttctgtcttccacaaactccactcctgccaaccccaggggtgagataactgtcacaggctccctcctttttgattttatgaccctcagaaagcccctttgcaggtgggtattcattgccatacacactgaggagcccaaaagtgtaagaactgctctggccctcgaagagttcactgtcttgaggagacaacagtgtgcacagattctgcctcattaaatacaataatgggggtatgaataaaatcagcagagaaaagaaaggcacacttgtctctgtctatgagggtggagaatattctcagaagtggtatgtgagcaggattttccaggataaataggagttctacagataggcaagaggaaagtgtgtatgttctggaaacacgccagcatgttaaacactggccctcattcccagctcctggaatcagcctatctggggaacagcgcttgctgctctcatcttgagctcctgcccaggaatgccacttcattcagtctgtactaaaattctggtcctcttagtctttacccaccatttccaggaaagtgcttaaaatcaaggcagcgagaagaaagctgctggcttgacagccgtcatatactagttaagcaaatgcacacacctcttccagattctgcaatggttttctgttctcttggcatgaagttattttttctctccagtcatcatgaacccccaagtccaatccaagcttgttaccaaggctccatttcctcccacctagctgagctctctagagcatcatgactcctggcctcttgccaatccacttgaattctgaactttctctaattagtggacctcaaactctaatctttctctcccctcatctctttctctgtctcccctttccctgcttacctccccatcttgacacttttcatatgtccttttccttagctgcgcatggccttgttctgcaacaggcccaaactttacaacaacaaatagacccaaatttagccatttgtagtatctacaaattctattacattcactgacccagaggtactctgaaagattcagaaaaagatatttgttactgaacttaaacatgtgtcctatttctagcccatgctccctgttgtgcactagaaattattatttctaataaatcttataatcacagtgtgagtggtacaattatattgcattacatatttgttggttacaagcatacattttcaaatgtaaacacataatatattccacaaggaagtattaggttatggcagtctccttttttttttgagttttgagacagtcttgctctgttgcccagactggattactgtggcataattatagcccattgcagccttgaactcctggactcaagtgatcctctcacctcagcctcctgaataaccggcgtcttgatgacttagaaagctcagctaggtgggaggagatgtagtcttagttacaggcttgatttggacttggcagttcatgatgattggagagaaaaaataatttcatgccgggagaacaggaaaccattgtgattacaagagcaagccagcatgacctgctaacttttttaactttttgcaaagactaggtctcactatgttgccgaggctggtctcaaacccctggcctcaagcaatcctcctgtctcagtttcgcaaaactctaggattataggtgagccacggtacctggccccattttttttttaatgtgccagaaacttttccccaacctatcttcctccctcatcaccagcaggggtctgcaaaacctggtccccagacactaccgcagaggtgagaatcaaagaagaaagctaagagagatgagaaagcacattaattttcaggttatgtacgaagagtttagaaaccgcctgaatatttataaattgaaagtgcattaattttcaagggtatacagcaagactttgggaactgactgaatgtttataaagtatattgctaacatgaactttaggctaatttatatttttaaatcttgcatgaataatatataagacacagagtgtcctagtcactttggattcctggtgtctagaaactatgaaaaccctttcccaatggcaggatgttataaatgtggttatctctgagacaagtgtcagaagcctgattgatatgtcctgtaactaaattatgcagtactaaatatgtcacaagaagtctcagagtttgttcccttgcttagtgataaggtcgattctaattggggatagctaaagattttatcttcagtctttccactccccttcctgcctcgcccaccgtccctaccctctaccctcctttcagtgcctcttccatgctagctccaataccctcatcatgagtcaggaatttcttctctgaggaataacgggcaagtatttctcatttttaaaactacacctattaaaccagctaaatcttcatcagaaaaatctcagataatagatagaagtcaaccatgctaagagttggctgttaagatcagttttctgttaagaacaggcctccaaatttctactttataactctcagatcatatcgaattccaaggttgtttttttttgtttgttttttgaaatggagtctcactctgccatccaggctggagtgcagtggtgcaatgtcagctcactgcaacctctccctcctgggttcaagtgattctcatgcctcagcctcccaagtagctgggattacagggatgcaccaccatgcttggctaattttgtatttttagtacagatggggtttcactatgttggccaggcaggtctcgaactcctgacctcaaatgattcagccgcctaggcctcccaaagtgctgggtttacaggcatgggccactgtacccagccagaattccaaggttttcacagcgattctcagggcttcaaattcagagacttaagagtgtggatgagaagaagcacctgaacaatttcaaacaccaaatgtcccttcgttaaagactgtctaagcagtctttttctctctcccctagaaggttgggcttctattttgagtttgatattatattgaattcattttaatgagattcaaacagcctgcattaatatagagcccaatgtgtttttccacttaattctatatttctctcctgattgatttcctgccttgcagccatggctatctgtgacaaagggactctgactctttgagcttagtatctgataattgtgattacataatacactaaagagtagctaaccgtagcatttaagccaataataaaatacactgttgtccttctaaagattttgctttccaagattgcaaaatataaatacttgattaatgtttctgttgtaaaagatgatcagaaaatagggatttggaagcgtcttcctttgtgagctctccacatgtgggatatttggaactttataccagcagatgccctgagagggcttttctctaaaaataaacgtctcttgaattcaagtctactgatttatttgattttaacttactttctccaaaaaaaagaccctacatttattcacatggctctttctagaaaatatttcattcagctggcacagtggctcacacctgcaatcctagcactttgggagactgaggtgggcggatcacttgaggtcagaagttagagaccagcctggccaacacggcaaaaccccttctctactaaaaatacaaaatttaggctggcgtcgtggcgcatgcctgtagtcccagctacttgggaggttgaggcaggagaatcgcttgaaccctggaggcggaggttgcagtgagcccatagcaccactgcactccagcctgggcttgagcaactttgtctctaaacaaacaacaaaaattatgattgacttcatgcttaaatgctaaagtatactttcctaagtccattgagatactttataaattgtgtctcagatatattttattttggaaaagcattttttttaaaattttgtcaataaaggagactatgaaaaatgaagtatttcccctaggaaaataagcaacttaaattcatatcctacgtgatattggcagggcaataaaagtggtaggtagagtaccatatcaaaattttttaacttatttcggcaaatcatttacttaaggggtctcctctgtcgcccaggctggagtgcagtggcgccatctaggcgcacttgcaacctccacctcccgggtgcaagtgattctcctgcctcagcctccctagagctgggattacaggcacgcccaactaaattttttttgtatttttagtagagacggggtttcaccgtgttggccagcgtggtccccatcttctgaccttgtgatccacccatctcggcctccctaagtgctaggattacaggcgtgagccaccgcgcccagcaacaaatcatttaaaaaatatttctgagaaaaaaaattaaagctgtagatagtgttttttaaaaatgctgtaaccatttatatttaccctttggctactgtttttttgtttgtttgttttgttttgttttttgagacggagtctcgatctgtcgcccagagcctcccgggttcacaccattctcctgcctcagcctcccgagtagctgggactacaggtgcccgccaccacgcccggctaattttttgtatttttagtagagaaggggtttcaccgtgttagccaggatggtctccatctcctgacctcgtgatccgcccgccggggcctccgaaagtgctgggattacaggcgtgagccaccaagcccgtccccttttggctacttttaaatctaatttctaatcccataattgagttcacagtggtttaaacagatatcaaacatattttaggtattagaactcatgatattgtcctgagaaagtaatggaggccaacttaaattcccttgggattaattaaaggagtcagaaatgattaagactgccatggggatatttgccgtatttttaaaaatcaaatacatgtagctagtaggccctgcaaaacatgtagaggcttagagaaatgaaaggcaaccaaggccccaatgtagggatctcaagggtaagtaggtggactttcctgtctcgatgctatgtaatatcacctaagcacctgctgggtccaagcattccagtttcactgggctggtgtggtgcagaaaggagaccccgcccattgaatgcaagacacagatagttataggaaaattcttctttagcgttcacttgtgtctctcatttcagagcaaaaacggggagttatttctacaatttgcagaaatctctcccttttactgtataatcatgcaaataacatgaggacagttaggctgtagtaaagtaatagagacttttgatgatggttttacccccttaaaatttttataaacaggaattagagggtttaataaaggacacattcattagtgagataaactctgaaggtaggagttcaatttcaggctcggcttcttgccagatgtttgaccttaagtaacgcatttaatatttctaaacctcagttctcttgtctgtaaaatacagatcctattaagaccttccttattggagtattgtgaatgttaatgaaattagctggggtaaatacattaaaaagtctcattcacagtgacagttccaaaattattagctattattatttttattatggtaaaaatttggaagaagaaacagttattttggggggatatgcctgggaataaagagtcaagaacaacaaacaatatctttataatccattaagagctatgccaatgtttgcaaggtttccttcagcaggagaacattaatacacttaaaaaataaaatccaaaaagttcttttagagaatagatgttttagattaattctgtttgttttcaaaataaataagaaccatggtaatgaacctcaaaggtgtattgtcttagagtttctggctttaatattgtaactgatgacattaaaggcaattaatccattaattaaaaatctgcatttatgcaaaggagaggggaaataaactacttcaactagcttctgacatatttacacttgaaatcaaagcttttgttaagttaaactagaaagagccgtttaacataagaaagagttaacactcgcttaggggtgcccttttttttaagtttgttggaaaatacttgacaaatctgtctgtaaaagcaactgcaaaaatattgtcactgcccttttgacagtctgaaaaaatcatggttgtcaaaataataagcaaactacattttataactatcaagagaaaaatatcagttttctactttataaagttgttttttagcatatcctagtgtgtgatgactgactaccatacagataggttgataatgtcaatacgtaggatatcttcctaaaagaatctaacacaatcccaccttccatttagcttgcagaaatacatcggcctactgagtaagcaaccaggcattgcggctgacttaaagaacatctttatgtccatggaaatgaacattttttaaacatctgtaagccctggtttcttggtaaagacagtaatagtagtaagtttgagtggccagctgttttccatatgttactcagaaacttttacacaagtacttacttcctggtagtgttgagtgagtgctagacctacattaccttccttaaaatgagaaaggaaagtatgtcaagggactgcattctgcttctgaagagctatgtacttagcaagtagtttactcagaagtaagagcctacagcaaactgatttcaaaagtcacttaatctttttagacaggctgaacatgtcgttccagaagcagcacgtgtaaattctcccaagacaagcaacccactgacactggaaacttgtgttgaagacctatcatttaaatgcgttatgctaaattctagagagaaaggaagcaaagatgataagatacggtttctgcccccaaagagttttaaggttttaaagtaaattgcctttgaggcctaaaagaaactttcccctctcctccttttcttgcactgacagtttttcgtttgtgttttttaacagtatttcttttgccctttgtatccatctttctattattttctgccgtgttggttcaatgattatgattttgctgctaaagtttttatttcttcaactcgtctgagacttagctttacattaaaacatttcaaataaatgtcagaaaagcagtgttaactttttaagacttgatcccggttgaggggcaacgtgcccttgttaatttcccaaacattaggtaaataagtgaggcgtgttcctgccctgtattctaattgtctggcaagaaaaattttcagttcaggatgagatgtttgtctcttccaaaatctatatagcattaatctcattgagataccccaaaatcccaaatctgaagtattgaaaaaaatacataaaagtaagaaagggaagtgatgtatcccctgggatctactctactttttacaataaaatgtggctataagaaaaaaaaaatcacattatctaataattattaagtaaagctctgttgtgtttattattacatcggcctaacaattctcatgccttttaagcactctgatggcttaaagaagaaatactacataaagacataaaaaagaagaaatactgcgtgtctataggtattttgtgcatctaaattcacactgacttctcaaattatatagcgccaagaaaacagaactactccagtttaagagagtctttgccgttctgaatattgtttctaataaaagtacatgctattattgagagaaagctataagagctaatggattaaatgttggggtatattcccaattccaccaatgactgagatgttacccttatgccttcctgggcctcactttgctcctctctaaaataaagaaatttaattttgtctattattccttccaaaagcaaaattctactgcatttctgagacatgtgtgatacttacggctgcgttcagttttccactttcattcatactactcaccttaatcagggaatgtattaattacaaattaaagataattatttgactcattaggtttagggtatatacatgtcaaataccctcaaccctccctccaggtatatcaaacaaaacctcgagctcctactgctgaaattcacattttcctcttacttgatatcaacatgttctatttttatgtctcataaatttaattatctgctaaaatgaagactgaagcccaatgccccaaacactaatttccacaaatacggattcagaataggtttctaaaaatttcagtatcctatttgtcacaattgtattgaatctattatctttcattaaattattccgtgtgtgggtcactgttttgccctaagtgatttaccacccaaccttgccctcctaaaattatttacagtgcagctacacaaccgttttcagcatgctttaggcttgtacttcctggagggaacttcacttcagtgacaaaactattcatctgcgatgaacactaccactagctccagtgccacctcccatgtagctatgcagtcactgcaaacatgagcaagcctaatgcttgctgcatcgcacgtgatttcatttaacaagcagtaatttcccttttctctctgagaatgacttggttcaatgtaaataaaggccgtaaagtttagttggaagagaataagagaatattggaagttgtgtagcctggagtaattgagatatgcaggatgttccaagttacaagatttattgtgtatctacagacactttatgatacaaatggcaatgagctaatagttatacgtgcttctggtgtcatagaactttagatgtcatttgtcatttatttaaaggacaaaactgaaggaagttaggttaggtttaggaatcatcaaaagaaaagaaagtgtcagcataaggagcatcacaggttcctatatcctataagttataatatacattggagatcagaactttttcttttctatttctaatatttagattacagatgagctcagaagctaacctcagaaactattttaagaataaaacattccatcattgcaattgcgggaatcttattggcaatcattatttgcatgttggaaaaatggtggtagcggaggtgatacaaaaaggagaaatctaatgctaccattttgacttacttttaccaagattaaacatggccatcacaaaagattggcttcctaaactgtggacatcttcccagttcttataagtaagggatggtttacctcaaaataacactgaattaaaagtgacttgtgtccaaagagctaaagtcagcacaaattataacagcccatggcttgctgagttctcacaatttcaagcatttgcctaaggccttcctcactcacttcttctgtactcacactagctgacttcgggggaatccagcagtattgccggcccccagtggcacagtggcacagagcagcctgcgaccacgaagatgccggcagatccccgtcacctccctccccaccaagtgtgtggaggggccagctctctccgcctccctgatcatttgtttactgtgctcaagttgggattcttggccaataggcagctcaagggggaaagaaacacggtgtcttaagtgcattaaatcttcatattagccccctggcttggtaaacctttatgttggctttgttctctttttttcaagcatgacaaacaagtggtttttctttttcactttaatgattctttaaacaaaaaggggtagtttagggctttctccgaggctgataggtgtttctgtttaatgaggtttttattatactgtattggcttccctgaaaagaaattacgagcagcaaacagctgataatagaaaaaggctggaagaaacaataaccaagagggggaaaaaattagtgtggcagcagatgcacgcgttgtagctgcgggattaaatgccacttccattctcccttggccaccattgtgcaagtaataaagtgaatgtggacacttatgtgccagttatgtgtgtgcaaaagatatagatatagatatagactcagctaaactgccatctgtggaggaagaaggctggtgagctcagtctagacaaagatgagtgaagctcagagtgcggggtttacaagggctggtcggttaccatggaaactaattggagctaataagtaaagggacattttaactgtgggaacagaataggaggggctatttttcaatatcaccgttacctacaattaatctttcattttaggagtgtctttacttaattcttattatgaagcgcttcactctgtgcacaacctcaccctgctcaatgtacttgaaaattcggcatatcatcttttagaatgtgctgtattttaggtttagatctttcaagacagaatcaatttcacttttttttttttcttaaaaaataaactgtttgcagatggcaaagagaaaggaagggaggtaatggaaaattcttaacttctaaactgacactccgctgagcactaaagcagactacagagagaaggggagctgggaccttatcctgcagcaccaacttcaggtttttgtttgagttgattttccctaacaaaagcatttcagaacaacaacgaaaaatgtgcctttgtggacttactcttacaatactttccaaaggtagcatttacagctactgcagaagcaagtattaagatcatagcaaacaaccacatctattgcatccttgtattttttattttaaagcaagtattaaatcgtgtaaatagctgaagttatcaataaaagagaagcagtgactgagttttaatgaaaagatctacaattaataatagaataaaatgtccgtgttaaaaagcactttaaacaataatgtaggtcagaaccaggcccatttgggaatgcctcatagacagtgtgttacaagcacagggttgataaagcttcttgattccgcatctgtacagtttcttaggttttacttttgtaactcaatttacagtttaagagaatgcgaactaccttaataatgtctctggggtcttcaaaatctatgcagttgaggtaatccagatttccagacatgggtctggttggattaacccccctcccgccaaaacaggaaaaaaaaataccttacaataattggcactattaaaaattttatgatgcccaagggaagttagagccccgttgtgccacttgccattgttgaaaatgtttgtgttgattatgtatctggacttagctgattaggagtagtttagtgaatacacaatatattgtgaaacagacacctcataatcacttctgagaagcaattgagcaaatgaatcaggactttaacttctgattctttttcttccctccttcttctttataactcaattataagaaaaaaatgcactgcagaaaaattagttttctaattttgtacatcagaaaattgcacccagaataatttttaagtatcttaatataataccacacacaaaaattctggaaaaacacaagctagtcaaatcaatgttgctagaaactgaaataattctccttgtgatactagcatgcccatattagataactatttatagtctaaattttaaggcattaggcaagtttaagagtttttttgttttttttttaaaacaatccccctcccagttcaaagaaatacaaaaggtgcaatacttaaaatgttggcttcccacagacactgtcaggaagttggtagtgtttaaaattcctattttctctttcagtttatcaaaattccttagatatctgatggaatttttgaaattgtgagatttgtggcaattaattgatttccagatatcttcttaaagtactgtaacaagtatagccattttctggttcagactgctgtcaaagtacttactttcattaaacagttcagaaaaccaaaaaaaaaaaaaaaatgcccctaagaagaaggtattgaaatgaccaaaaattgaaaacatttcaaagcaaaattgttaatgagctgtttgagctatatggacattataagtgcaattaactagaagccaataaaaataatcaatgacagagtgcagccctctggtaccaaagtgcttttacaaagagatgtctgtgaaagcagcaagtgattaaaaaagccacctttatctatgggagcgcgtgctattttacatgagtagaaacgaaaatgattttcattgactatttctgaagttcagcctgtggcaaacagtgaagagctgtgtgtgggaatagagaagtttctgctcttagctgcgcccccaccccctccttgccaagaatgttggaggcagccacgatctaatcaaagaaaggtaggagtttagatttcaaaatgtagatgtcacatttcagtgccaactactcctacattaaccctttatcagcaagtcaagatgaaccttttatctcctatggaagggaaaacgtcttgctgagatggcccttccatagacgggcagtaaaaatgtttagggtttctgtgcatcccactgagggtccccatcatctcagggggagcacgaggagttgtgaaaagtaacgcacaactggtcatcagaataattcattccctccaccttctctgtagcacctcccacttctcctctttttatagcagtcctttctctctgaaaatctcaggttacttgactgggagttctcagacctccagtttcagccctgccctcagcctccaatccgtaagagacacccagccccagcaattggattgggcagcccgtcttgacacaccactgtgctgagtgcttgaggacgtgtttcaacagatggttggggttagtgtgtgtcatcacattcgagtggggattaagagaaggaaggctgccttgctggagctgtgtggtcttctccaagtgagagtcgcaggcaatagaactactttgcttttggaggaaaaggaggaattcattttcagcagacacaagaaaagcagtttttttttcaggtaaagtaaaagacattgaatgcttctctccccctctctcttttagcatagttttgaatggaatgctagcacggcacacttgtcaaagccagttgttgctgtcctatcaatgctgctattgtacggctgacagatgacggtgagcatagcttgatgcttggctgtctttgtagaactaacactcctcatgccttgcttttgaaggtgtagctaagaaaatacctttgggagccgcgtttgtaccttttcatatccccgttgtatactcaaaacaggagctataacttgcttgtagaggatagataaggctgagaaaggatttattttagctttcaaaattaaaattcactttcaaactgttgcattttactgctcaatttataaagattctttgaagggtctattactgagttgctggcagaggtggaagtgctttcttcaccgatttgtgcaaggtagattatgtctgatttatgacagagcaaagggtgttttaaaatatttttggagattgactctgaagtttggaaactcctgaagagaaggggctaccctctgaacagccactaggtcggctttaaaacaaaaatgcttagagctggaagaaaagcagagaaggaagaaggaggaaaatgctctttaacatagccctcttgcagctgcagggaaagcagatggaggtaattgatttgcagatctgtttgtgaaagttttacaagtcatggaaaactaaagtagcatctctgtaatggatcattaagagtcactacatttataggttttagaccggctaagtgaagtgttaattaaacgtaaatagattttcaggtttggttataaacagacaaacagaaaggatttaattataaactagtcattggaaattaatagtcatctggtgcctgagcaacacaaaatgagttgtcatcatatatgcgagtagccgtaacggctctaccaaaagcacccaccaatattgaattgaactatttataaatataagaagggggtttatatgctatgtttaatttatagtattaaaaaaaaggcctttcaattcaggctctattttcacagggatcaaaacataaaattttttattttccaaattttctagcaagataggtgagccaatgagacttctgctaccctaatatacttgccctccgatagcaacattcatatacctgtggtatgcagagcttctggctcctactggactttcacatttggcagagaaatccagcattatcctcaccctttgcaggtgagagattctatgaataatattgtatataagctgttctgaaataagagctgtttggtaggttgaataacaggatttatggctagtgctttgtgattttagtattcgattgcataaagatgcctgtaaaattatgtttcaagttgcattatacatatttttgcaaccatgcagataatttttttaaaatcctttttttaaaaaagttaagattaaaacaatattttaatatggtctttaatttttattcaaaatgttctccagttatactctcaaacttctccttcaatgagaaattatcctcataaatacccaggcagttattccgactgagtattatctgattcccaatattacataaccaaaatagatccaagttcataagctgaagtctttcggagttccagtcattccattttggctttacaatggaaatgaggttttaaaaaataaagacagaaaggcaagctaatatctcgtgttgtatcaggattagaactacatggacagcatatagcatgcatggtgctaactaccaataccatttttcactactgcagaaatatttcacaagaaagtcaagtgcctcctcacagatcggattttcctccctgagatgtggcatgatggcatctaacagaggcaaggtgctatttagcaacaggtgccccaccagcatacatccctgatgttgcagatcgatcacagggctgcctggacaggactttgacagtatgggacaattcccctgaaaaaaacaattgtacacaggattaggcaggatagaaacaagaaaggaagtgtggagagataataaattcacaccttgaaacggcagccgtgtttttgtccccctaacagggtaatgtgaagttacttcgtgaactgaaagggcttgcttgaaacacagtgtccacagggcaatcccagcttcttgtcaaaatcaaaatctactgtcccaggtggtaaacatgcagagacatatttatggcgacctctacatacctcagtttgacatttggtttcttcctgacagcacttgtgctggtaatacacatgaagttcccatcagcattctaccagctgtgaaagtgtttgagcacacgggatatcccttccagagaagcgaaaaataatggaggttgaggagatctgaaatgtgcactcggtatgcattaaggtgacagatcttagaggtgaaaagtgatctgaaagcttgatttgtgaaagtgacaaaattcatttttatggtggtgtgcaataccaaaatacattagtccaggtattcactgaatccatggtaggttatgagtaggaacctccatcaggaaactagaagggttctactctgttttccttctaagaaaatgtaagtgacttcatgcagattgttgtagccatttccatcataatagtagagacaagtggcaaatgggacatttcctatttccttccctaattatgtatccatattggaagggttagaggtttgtttcttctgtgttttatattgaaaatgggtttattctttaaaaatcctaggaccgggcacagtggctcacgcctgtaatcccaacattttgggaggccgaggcgggtggatcacctgagatcaggagttcaagtccagcctggccaacatggtgaaaccccaagtctactaaaaatacaaaaattagccaggcacggtggtgggcacctgtaatcccagctacttgggagtctgaggcaggagaattgcttgaacccgaaaggcggaggttgcagtgagccgagatcgtgtcattgcactgcagcctgggtgacaagagtgaaactccgtctaaaaaacaaaaaaaaccataaagcaagatttctgatactgagctatatatagtattgagatttccccaaccatcgccacatagatgaggccaaccaaagagtcagctcaggacatccggttttttttcccctgtgcaatatttttgtgtggagaacataaagtaaatttaaggggattaaaatttttaaaaccagactctaaatagatggtcgcttttatcattattgactttggggagaaggaggctcatgtatgaaactaagtctatgatcatgtggtaaattcagcttttatttaggttagaaccatgaaaatttttgaaaggagatatcttatggaaaaaaattgtcctgaaatatgtttcctatttaaattctttttaatctatcttaatatcctgaggaggtggggaattcgccagttagcctttttttcccctctcatattttcctctcccctatagccagtctgtcatcaaattctgtgagtccttcctttaaaatatctcccacatgtggcccatagctaccatcccagcgcaatgatcatctcacatgtgggccattgcaacagcctcctaaatggtccacttgcctccatttccctcttctgtctactactgcagactcagcttcctaaaatgtcagtttcatcaaagctcttctagtctgaaaattaccacataaacccttactacccataaaatgaatttcagtcctattctaatgtgctggccttctattatttggcccgaactttccaaccatttctccccgccaaatccccacaacctcagaagtctacccttccttccagctaaagtgggcagcacagcatctctactttctagccttttctttcagccctaaccactctagttttctatcttgtctttaaaatgagtttgtcatcatgtgcacggttccttctaagtctacattcataagcctgtgtgtaaaatgccccactcagttcatccttatcacctctatatattcatccttcaaagtttcagcttaagttccaccgcctttgagaagcctctctgaccgctacctcttccagcaatgcttttcttcccttcatgttgaccactggttatctatggattgcacttaaaacaattgctttattttttattctgctctatagtttgcttctttattccttgacttctcaggtggagtgacagggactggcctggtccactttaatgacccacagaagaccctaataagtgtgcttactaaactcaccaggacattcgaacactcaagacactttcctctctagagttaccccaatttagagccattcactggctccggtagcttcctccccacccaggacaggaaacgaaaaaaaaaaaaatgaaactcagtgggttttatttgggggaaacttaaggaaaatgcccctaaggcagaaagtgaaataattgccccagattaagcttgagtattatatgaaaaatccctatgaagttcagctttaactgtagtagaaattacatgtattggctgctgctctatcataaaatcccaaatatggctttggagcaggagagtacaggctctgggttcaaacagacctgtgttctaatccagggaccacctctctagctgtgtggccttggacagcgaactgacccattctgagattcagctccttcctctgtaaaatacagataggagtacttatcttgggaacattttaaagaaaacacataaatcacctagctcagtgcatatccaatattgtatgttcaataaatggaagtgagagagggttgattggtgcatatgtagatccagacctaggatgcaggaatgacaaacgttcagctatgtcagtcattaatcctatgtatctatgatgtgccttcctttagcattttcttctgccaccaaaggcaggggaataaggaaaggagggagagagcaagggagagaaagtgagagagagagagagagagaaggagggaggtgctcttggcatttagggatttggagcaactgagctaatggctctgtagggacagtagtgacagttaaatacacgttgagggagaaatgaagcatgaagccctgggtcctgcaccaaggataataaagagcaggccctgggccactgtgctatgctgttggggaacaaaggaccccatccctgtaccatagcagggatttggattctctaagggtcatgtgcttcccttctttcctcctggctcaccatctagaaagaaatattaataaaaacttggcaaaacattgtagagagtcagatcgagcttccagaagtaattgataaagcaagataccatttagacttcaccttcaaaccaaatttaacaaaaaagctgaaagcaatcagcttgagccccttaccattcccaaactctgcacccatcatcaaacattgaaccttctatttctgccttttccctggaagggcagctgactgtgaaattctctaacaaggcactgaatgccacttagcaaatatgtccttagacattggatattcagttctagctttctgatcatctggtctgcacctgccctcagccagggagaggaaagaaactggaactgcctgggatgatgggtaaggcagtatttctggagatccctccctctccctagcaaacatatctatcaaattttcaaagagaggcattaacaatcacatttgacaccatcgtcacctgtagccgctaagctagtcttcgttgccctctaaatatgtggtccatgtactcctgcacagtagtgtattaaactttttaaattttaatttaatttaattttttgagacaatgtctcactctctcatccaggctggagggcaattgcaagatcatagcttacagcagcctccgtcttctgggctcaagtgatcctcctgcctcagtctcatgagtagctaggattgccagcatgcaccaccatacccagctattttttatttttaattttttagagactgggtctcactatggtacccaggctggtctcaaactcttagcctcaagtggtcctcccagttcagcctcccaaagtgctggtattacaggtgtgagcaaccacaccggccctaagccacttttaattaaaaaaaaaaatgtagctcttcgctttaccttcaaaggttaaatttttcttttgctgttttatttttgtttttgtttactacacaggtacaaacctgtaggaaactatgtctacgttttctaaaatatgaatctaagggacttggacatgctactgtttaactgctgtcggtgagattaatactaaatctctgtgcggaataaatgaacagacagattgtgtttctcaatcaaaagttttaattgtaaaaggtagactctctcaaaataaatctataaattttgggtcgtactaatcaaattctaaaataaagttagaaggcttgtgatgggagtggagtttgggaactggcaagagtccacatggctcttgttgaatataaactaaaaaacattctaaagctggatggacaatcaattcatgagcaagcctagacattttcataaaacagtatccttgtaagatggggatttgtcttattacatatccaatcacattataccataacaattgaattgtctgttcttaagcaatggactctgatgtagatttcatctactgtcatgtagttttcctcttgctcttctttgttttgctctattcttttgttggcattgaccaaatcttcagctgagcaacaaactgctgtaaccagatgctagttctgttgctagaattaatggaaactctgaactaatttttttattttgtcctatgatctttccaatcagtaaatagtgttactaatacatgcaactttttccacttcatagtacgcaaataatttctgagacaggtttgtttcaagaactcaggaaaatctccttgtattcctttgatgacagaggctcaaagattattcagtctaagtgtcttcccattttcctgaacaacactggcacatttagcccattcttaaaaaccaaaatggaaatctgaaatacaaagagttctgtttattgtccagtttttttggtatgatgttacaggcataatctgctatattaatttaaagtaaaactaaaggttacacaattaaaagatattagctataccagaattatggtgggaaaagactaattgcattccaatgtacatttattgatcagttactttagaagtgtgcacctctagatattatcttcaaactcctatcacaaatatgcctttgcttcccaatcacctttctgtcatataacatgtgttctgaatagacttcttgccaatttaaagtttcacccttaaccttcacctgccaataatcaatcttctcctgaatagaatgtccctgtaaacagatgtgctttaccgtgcatccagaaattcttgaaaccagcttttaactttcatcttataaaaagtgcatcccacaaaagacaggccccctacaaatcatgttctctttttttcttctgagaactttatgctggtaaaagaaaagaaagttttccgaatataacagataaataaaagcataggacatgtaatattttttacttgggatgcctagaggctttacatgtgttatcacattctttttcatatgtgatattgagatttagtaaaggagatttatgatatggacccaatatcaaacagattaaatctttttattttactttgactcagtttccttctctgtaaaatggagttaagtttatcacaaaaggttgttataaagattagatgagataataaaataagatgcttaacacagaatatagaacagagaaactgcacaaacacaaaacacaaaagctacatttttgttccaagatggcaaaagacatggcttgagctgaggcttggtgataaagtgagtatgtccttttcaaataaaaatagcccttcttaatctcatgatctgtatgacacaatttggaaatataatgaaggtggccacttggcaaagaagagaaagaggaagagggagggaaagaggatagaggcaaagaagagaaaaaaaggaatggaagaggaggggaaacattgtgatcctctcttgcctctgctctgtgccttgctataataagcatttcatgtcatagctaagtcaggccagattctagagtgtcctaacacatcaggtagagaggttggacttgatagctaaacagatgccttaggaagttcaagcagtaggtttttaagaataaagagagattaaggaaaaatgagagtgacagtgagtgagcagagacagagagagaaagagagagggggataacaagacaattgatccccagagttcaaataaattaaaaaaaaaatgttgtctattcccatcgacgcagtgggaataaggaaaggatgggtgtaagaaacatggtgaagaaataaataacaataatgcaacttggtgattagtcaaatagaggacaaaagagagaaaaatactgaggtatcaagcccaggacacagggaaatggtggctcaatctaaagctactgaaaatggaatttcattcggcaacacaatacattcccaaagtgacaatggtcattatggaacaaatgtttatctgttatctgtgaacagactacactcaatagaactttataatgcaaacatatgtaaatatatgtgtatatcaatgtttaataatatatgtgctgctgaagcaagcactcaatgtttaataatataatttaaatagatacaatctaatgttctgatcattggtgggcattagacagaatacacaactgtgattttcataaggcatatgccgccttagatttaaaaaaaaattttctcagattaagaaaatggttggccaagtaacaatctagcatttctataactttggggaagttacggatattcgagtcaaaatactcaactacatctgcataacacctatataattctcttcttttgactaagagactgttagtggagcggaacatgaaatttaaaaagtctagaggcaagaagagatgaaatatttaagttgcctatgctcacaaaccttcatattctaccttggaggaggctgattgacatcctttcacagaatgtaccaatgacttattcacaaatgaaatacacgttcccttcttcactacaaagacaaatcatccttaattttatgatttgggaatggtttccccattcccctgcttttctttctatccccttttgttttgtccttttttgttttatttgtttcaaccatttcctattcaaaataagagggccattctctagtcaagtcttcctactaaatcaatgggcagttttcagaactaggtatagatttcttagaagtagaagattgtgtttgccttttcaaactcgtgcattatatgttggaggcagcatgactgaaagaatacagagcttgagtcagcaaaatctggaactgaaatgtagccctgttactgaaaatttgtgggaatagcattgaccatggagacttgacagcattttcgttcctcaaaagagacttgggtcccattcaagtttttaatgaagactttggcctgttctatgttacccaactgggttttctgaaccatattccctagttcccctggaagaaacgccagcctaagtatcagcacctgtaatctatttctcactcagggttgccagacatgagggattaattgacatgagccagtttatatttggaagccattaatggctagcaactgaattgttgagacatccagtgcaacgaaccagagaggaaagaataacacacaagtgccatagttagatcaataaacatcatcttcggcaagcacaaacgttgggtttagctgccaaacttaaaactaggtctcttcatctagtacccacttaggtcaatgggccagggtcctggtatagagattagggactgaaacatgagttgatatttccaaacttcttaattttggattgtctaagttcagatttcaattcaagattctactcctacatgttacgcttttagatctgtcttggaggtacaaagacttctggaattagagaagtttggtccttctaagaagagaaaaatgaataagtagagaagtcagaaaaaagaatacaatgcagtcaaaacatgttctgtcatacagagtcaccttaccttttcgatgtaaaaaccaggacagaaaacggggggaaaaataagctatatgaaaaacttcatgtatagcaattgttattctcattagcctttcttctacaaaaatagctgtctattcatctaacattctggtgaactactacagtagtctcagaagtgaaattaaaagtgttcctacaattgcttctaccactgtcataacccctttggaagcttagaatactccacttaacttcctcatctgcttcaggcaaatcatatttcttgttgcgcaaataaaattaaaatgtatattttattattcccctggtaacttttcaagtctgaaaaaataattaagcacactattagcaatgaaataaaatttgctgaataatgacagcagtgttggagccaggaaaaagaggcagggtggtacagtggaaagatattagaaatctggattctagaacttggctactattaatagtgtgattttgagcaaattagttaagatttcaggagcatgccatcatctctttgcctgcattctgccattcccttcacctagatggcattattctccttctttactggcaaactctgctcttcctttaagacaagcttaaataaataaagcattctcctttgtttttttttgagaaagtgtctcgctctgtcactcaggcagggtgcagtggtgtgatcatggctcattgcagtgttgacctcctgggcttaatagatcctcccacctcagcctcccaagtagctgggacctccagcacacaccagcctggctaaatttttcctattttctatagagatgggttctccctatgttgcccaactggtctcaaaccgctgggctaaagcaatcccctgcctcagcattccaaagtgctaggattacaggtgcaagccactgtacccagcctaagcattctccttgaaactaaaaagaatggttggaggaaagaggaaggacttcaatccagttctgcatcacctcgtgcatctgaaataagctctgtaccttatctctttcttatctccactcatcttacctactgccattaaactcatcttatttctacactgtttcatcatatcactccactactctaaaacacctgtctcccaattttctgcagcatccagtctaaataaatgaccagcaattaagaacctccatgatcttttccactatgaccatcccactccccctatacactttctgctctttcctaaagtggttcaacatgtcctgaatttacatctttacttctgctacaaggcacgtgctcacactgttttctgggctaggactgcctcccatcatggttctgcatgtccaaattccatccatccttgaaaagaaagactcaagcctcattacctccatggaactttcttttcctaactcttccaaccatcaataatctctctctcatctgtgctctttttccacttaaaatcttgtcacataattttagctcttaattatgtacaattttgcatttattcttattctcatcatttttttaaattgccttctctctcttatattttgagaaacagtaagacaagttgagttttgagcctctgcatctatcaagcatagcttcaaggtggtagagccagtacatcctaaaggccttcattacacattcacagttagaatgatcaaggactactgggatagaacattatattttagtcattgagaattttaggaaactaatcagcagcacattcacaactaccccgggcattcttttgacaatgtggaaggcaccatctcatgcactgattctctggctcagattttttgtttccatcttctgcccacatcactctccagggctgcatttgcgccagctggattccatccagaaacagattcaaatagacaataggccaactagaattcccatcttccttgattagatgtgaaattgtatagctgggtgtcactcacatgccagccactcaggattctatgttatcaattaatttctcttgagagctgaactgaggagattgtgacaattctgttttcaaggacctgtaaaataacagctagaccagatttttatggatagtgctagatatataggcctgtccactatctgccgcatagcataaattaaaacaccctgttaatttcatagtaaatcgtattgggtgtttttttcttctgcagtgtgaatggattgtaaaaattttgtctaggaatggcattctcatttgtaggacaattagcaactgaggtaaaaggtttatattacttagaagaaagacgaacttattgcacactgtcaaaactactgaatcttatttgttgttgttgcttcaataacttagaatttgcagtggattttccaggaaaggatatcatagaaacacagaatgttggaggcgtacctccaacaatctaagctaaatctaagcagaatgttggaggcataccttagagatcatctaagcagaatctctcagtttacatctgaggaaacacaggactgggtttgttgggagacctgcctaaaatcacaaaactcattcttacaaggcagagttctaaatccaggctttatctttctaaaaagtatgagtcggtaaattctaccgggatgaaaatgagttcatgtgtccactttacattgggacccgacaaggaaaagagatgagtccagctcccttttcgaccatggactttcttgctgagggctaccgtgagtaatcaggcagtgtaaatgatgattgggactggaacaaatacaagaaaaagctttttttttttcagatgtactccttatggaaaatctgttctaattgagatcaccaagcaccgttgctatggatgatctgtgcaaacatgcagctttatcatagagaaacttctttgtaaaagcattttttaacatacacttaaagaacacactatccactgttgatgatgacaatattaaccattacgacttcaaaacaattttcacttgcactaaaccactggaacttgtaatatttgagtaaggaaagcagtgtgtcatttctgtacaccagaaaactgaagctgagggacagcatgccatttgcctgagtctaaacacctgagtgaggtaattagtgttagaactcatgtcttctggatcccacttcactgcctaatacttcaaatgatttcaaatataccatatttggtcaatattagggatacctattgcattagaacagttgaactgtccccttagtaatgtcaccttactgggaaataaacatttgaatacttcctcaagtactggaactttcccaagagaagtatatgagcaatattcttcatagcttaataaattacatgattgtatatacaattatgcatctatataatttgcatttgaagctgatttatttgtaaaagaagtagcagtattcattattagattataaatgtatttcctagtcataacttccatttgttattttgtactataaggaataacaatttaataactcaaaataaaaagattaatttagaatatcctaagtatgattctgactttttaaaaaagttttgtttttcactgcatgttctcactcataggtgggaattgaacaatgagaacacatggacacaggaaggggaacatcacactctggggactgttgtgggatgggggaggggggagggatagcattaggagatatacctaatgctaaatgatgagttaatgggtgcagcacaccagcatggcacatgtatacatatgtaacaaacctgcacattgtgcacatgtaccctaaaacttaaagtataataataataaaataaaaataaaaataaaagttttgtttttaagacatgttctagatttcctttttggtgttgtaagtatctcaagaaagccattatgatttccagagcaatgaaagaaatacgtcataggaaaaagagcattttcgttcatatttttaggttattggtcatatttcaatccactggaaaatgtgattgcaaatctggttagatttataaaaatatcaggcttaccagtattacaacttcttatgaaagtgtgaattctgttgagaatgtgaagataaagtggcagaataattatctttttttatatctaaactttataatagtgaatgctgttgaaaaagggattctatgaaagttattttttgatccataagaatactttgttcatactattttccttttcttaaatttccaatttttattttaagtttagggatacatgagcaggttgtgcaggtgtgttccataggtaaacgtgtgccatggtggtttgctgcacagatcaccccatcacccaggtattaagccaagcttccattagctattcttcctgatgcttttcctcctcccaaccactcaccctatgacaggccccggtgtgtgttgctccccgccattgtgtccatgtgttctcatcattcagctcccacttataagtgagaacatgcggtatttggttttctcttcctgagttagtttgctaaggataatggcctccagctccatccatgtccctgtgaaggacatgatctctttcttttttatattcatactattttcagctaagcctatacattagacacttctataaaacagtgcttccctatttcctatttatatctcagttgttgtttataatgaaaataaagtatgccattttcactactcaaagaaaagaccagaagaaataaagctgagctcttactaaactcttaacagctgtattcttgatcttccattgagtagcaactgctctttagtttctatcaccttgcctcaaacatggtcataacctccaccaaaaagaccacataaaatagcaaactgttgaaatgagaaagagcaccaagaaaagatgtaagtccttgcaggaggaatgcaactcaaaaaggatgacacagagggtgagggcatcagactcttttgctctcaccactgagaaaaatttggcactataaccggctagataatgggctctcttcatttgcactctactaccatttgtaaatcctctgaagttttaagtaatttgattttccccatagtttatgaaatatacaacctttagttttatataacaatttatacttttcaacatgcctttaaacatttcatttggttttgacaaccttatggatcatgccacataactaagtacttgtgcccattttaaagaaatagaaacagaggcacatctttggtgacacatactgaaatattaatgtatagtggtataagatcatgatgtgtgcagtttactgtcaatagttcaagggaggaatatatatatatataattttataaaatctctgtttgtatatatagagagagaggggcagggggagggaatgaaattgataaggcaagacattggggcaagtcgttaaccataaatgactatgggtaactggtatgtaagtgttctttctactattcttccagcttttccgtaagtttgaaattattttcaaatacaaatttttaaaaattaattaaggaaaattaagtaatttgtataaataaacagctgattagaggcaaagtgaacaactaggatccaggtctcctaactataatctatttctgtaaactgaaagtaatttccacttaaattatagtcagcccttcatatccacagttccacctcagtggattaaaccaaccttggatagaaaaactattcaggggaaaaaaatacaacaataaaaaaatacaaattttagaatacagtatattatatttacatagcacttaccttacattgggtattataagtaatctagagaggattcaaagtatatcggaagatgtgtgtagattatatgcaaatattatgtcatcatatatcagggacttgagcacccctgattttggtatctacagtggggctctggaatcaattctccaaggagaccaagggaacgagggagactgtatttataatcacaatcatacgttttgccagtcagtcatcaataatcaataccatagctcacgagaaactcataatgatttattaataacctttatttatatatcatactacttattgcaaactgttttcactgaccttattttatttggtcttcataatgcttccaatgaagtggattggacaggcattgtgggacccattttacagactaagaaacaggctgtgaaggttacttataccattaatgttcacagctactaaacggcagaatttagaaggatgccaagagagaatactggaaagagcactggttctggaatttaggatttaaattccaatatgccttcttagcattctaatgcctttttatactcctactgaccatacctaaaacttctagggctcgtattatatttcgcaatagaaaagcaatgttcttgccggcacggtggctcacacctcacctgtagtcccagctaatcaagaggctgaggcaggaggatcacgtgaaccttagagttccaggctgcaatgagctatgattgtgtccactgcaacccagcctgggcaacagagcaagaccctgtccctaacaaagcaaaaaacaaaaacattctcttaaagaacaaaacaaaatgactgagaaagatgtctgttttacttactaatgttatatgtaacaataacagctaagatttattaaatacatgcttaccatgtacaagtaagtgctatacatacattatctaatttaatttatgcaacatctctatgacatagaattatcttggtcccagtcttacaagcaaggaaataggctctgagagtttgactgacttggccaagtttacagacttgcaggggccaaggttggatatggacccagaaatctgactccatacccgctaccattaactagtccttattccacattttcctttttttcctttaagctcagttgactttttaacgaatgtcttttcctcatatttagtaatttttaaattctgaaattaagataatgctttctagaaacatagtttatatggaaaaatatttgcatgaaaaaatagaccctccttcttatttgcaacctcttgaaagcaggcaccacatcttatctgcatcaacagcagctcctggcacacatggaacattcaataaatgtttgttaaatgaatgaataatgttcagagttctctattaaaaagttcttacatgatctaaatacttaaagacaggacctaaaaattaagttggctcaattcaccaaatctcaactttatagtaaagcacacagttttggtcccagaaaaacaaataaatgaaagcagaaaacaaatttcacttttaagaaatttttaattctgcccttggaaagttgaactgctctgtggatgtttcaacaaatgtggcctttaactatctggataatcttttttagattataatctatagtctgcatgacaaaaagtgatgcccaggctcactaatgtctgcatttcattattttccttttgctgtaaccagataggatttaaaaaaggagaaacagtcaagcaaggaccatggtctcaggaaaggaggagaaccacctccaggatatacagcttgctttcatcttcctcttcttcttcttcttcttcttcttcttcttcttcttttcttcctcctcctcctcctcttcgagacaggagtcacaccatgttgctcagtctgatctggaactcctgagctcaagctactgtcctgcctcagcctcctgagtatctgggactacaggtgcatgtcacagcacccggctacagccagctttccaaggtgcccatcacagctgccctctgagcaatgactcaggaagggaccagttggagggaagatgggagctcaggaaaagtgtcaggatacaccttgcaacctccttcttctaacccgtgctttcagcccttccttttgtggtttcttcccactccaaaatttcccataatatttatttgcataaattttccccaaaataggaatgactaggcatattgagaggaccacatttacctaccgcccttcccactttagtaatagcatcattgttctaccctgtgcattccagtatagcacacagacatcttaagtgcagaacttaactttattgcaacataagggaatttcggggtaaaaactgcattcgtgaaatcaatcacacatggggctcaggttactcagcctggcatggttcaaagccttatagcaattcctcgtaggcgctgcctgttgtcactcccttggctgtctgtcacccttgcctcaggctccagccttagcctcagcttcttcttcctaatgcacctgccagccccagacatgggtactttccagattctgcagaatgaggctttttcctgtctaagtctcagcacatccttatcagcatctcacacagactgcaacctctgcagtcggcttgtgtccagggtcctagtccccatcactgcttcctctttatactctccgcccaatgcctgctcctgtgcgttcccacactcctgccctctggcatgtacagtttcacatttgtaatctatgcctctacgtacttacaagaagaggaggtgaaaaactggatttggcacatattgaatttcttggaccgtgttcatttttttctgtgtctggaatccactgttttctagcaaaaactttcttaagatttcaaacaccaaccctaacactctgagtttacctgcttgaatgactgcctgtccctcgggctgaagtcacaacattcaggttattattaatgattgtcaatcaccatctttttgggtccctgttgttttgccttcatataatttaatatttctatttaaacacagaaacttgggcaactgtcagagtcactcctcagctaatgctccctggaaagggcatatgctttttgctcactcaaggcagataatactgaacaagtgcttaagaacgttcatgccataaaagactctcagaaaaggaaggagaaactgaacgataccgagtccttacacatgcaggacacggctatttcctttcagattttgtaattcctatactggtcattctagttctaagtaaagaaaccaggctttttttaaaaaaaaaaaatcacaaatctgtagagctaggatttggacccaagtcagtttgtctccaaaaattcatgcgttttctcaaaagaaagttctatataaatgctaaacagaaaacccagtcattaattacatggaggcagtttacattttcctgcaatttacacctttttttttccagactaattaaatttcctacgctggtaaagtgcttcttcccacagtttactagagtttttggtaaagagctaaaagaaggtttgctgtgaagctggcgaggaagagaagactgagattccaataaaaacttgttaactggcgtgcaacaccgtgcctattaagagtagaacaactctcctacagaacacacagccgagtctatacattgcttgttaagtactggcccaagtgctcatgtctcagacttgtcccttggacccatgcccaagccagccctgagagggttggaacaactcccccgcccctgcagaaaacacgactggttatttagaatctagggcatcacaatgaacatggctcagtattttcataaggtattactactgttgttctgaaaaagcaaggcatgcgcgcacttacttaatatgttctttgttgatttacacgtccttgatttttaaatcacttccagaaattcctagtaaatgggaaaagaatttctcaaataaatatgttatcttttcctccaacagaatgccagatcacttcttgaaagatcgtttccagattcttcttcagttcaaactgattttcacaaacttgaatctgcacgccataattaggaagctactgcaggccaatttatttggttaatttgcatcagtctaaataatttttcctgacagattacttccgttctaagtaccaagtactttttaatcctagtcaggttattgctaaggataaatgatttcacatttctcataaagatgcctgtcattaagaatattaacacaaattccttccccttgaatagaaatgagctgtcattttagcaatcttgctgtgtcagcctttctattgtcaaacacaacaaatgatgggaaaatcaatttactctttagaattagtcaagtgaggaatcctttgaagtgggggtgcagagtttcgcctgaattctataatcacgtaacagcgagtactgtatgtatgttggtaaaatgttgtgaaatttaatgaggactatttgttgccataagaccttccagacagaatctatctctgaaaaagaattccccactcctaaaatagaggtctgatgagcaacagatgtggtttaaatgaacccttgttcaactgaaccaagaatatattgtgatctgtatgaggcacaattcagaagagaggggaggtggctacagcacagcctcagtgttgagtttggttgtggggtttaaacatatttatttatttcataaagtttctctcataaggcacaatgcaaatgagcttttaattaatacaatctaatgttcagaggatggtcttcatgctgtttataaaacaatttacatttttattttgtagtctaagaacgtgtgtcgaaaagcatgtcagtgagtagccataaccttcagagtgatctatgtcctggcaatgatttgtaagttccacaactcagtttctccacccataaagagaagattagatcgttgttcaagaatgacaactatttaatatttggaaatgactaaataatgaagtgcctggattctatagaaatgccgaggagaaaagaagattaatttcaaaccaaagtctagtgcaaacatgaccttcctattgtaaatctcatgaataggagaagaaataacatctaaagctttgtttctagggctgagactctggaaatatattaattttaggttgtttctgatggcaaaaaaaaagatccgtctattacaatctcttgcctgtggagatgagaaaaaattcttcctgctacctttgactgaaataatgcagttagcaaagatttaaatgacaagagtagaagtgtcatctttttgtccctttgcctctaggcaggactacagttaagccatctcaggaaagagaagagtgctattgctcccaaaactctccaggtgagaatgataaaaattaaaaacagcaagtgagaaaactcaggggccctgaaattaataaaggtcagttccagctcacatcgtttcagttaaaatttatttctatttggaaatagcctaacagcaaaactccaacggatgggctgtttggcactagttctcggtgaaaattccatttagtattactactactgtctgatctttttctattcagcctcctcttcaccctgttggtgagggagggaggccatcctagggatctggggatggccaaatacacagcacccaacagtggacagatgacagccacagcagcttaaaagtcacataaactcacagcccagggaaggaggatcagggaaggaggataacacataccatgcagggcacacaggggttgcaccgggaacagagtggacaagcagaggctgcaggaggcagtagtaacaagagaatgcggtgccctgaggctccccggggaaggtgtaattggcttgtttgaataattgtgtgggctggtaaggaagtaaaacccataaggttgaagacctggtggagtgaggctggcccagctgacagaggaatgagccaggtgggcgtcctttcttgctggaggggacatatctatgaaagcaggggagctcacagttaggccttggggggtcctgatgaggctcaaagataataaataccaaggtaacacgtgagattttaggcgttacaagccgatccatacaaactaaaccgacttatatgagactcatgttcccttgaccatgcctgatctctctaaggtcttttccacacctattttgtctcacaggaaaagagccacttttgactagattgataaaatgggagtttaagcaatttttctagcaggaggactctcaggccaagaccatgtaattagctaaatgactcatgcagaagtatcctacactcctccctttggtttgaatgaaaagagtaggagagccctaaatcatccagacaaattacatctttaactctttacttaattttagtctgtcacaaggtaaatattgacaaactttagacttatagccagagggctaaaaaaaaaaaataagtctagcttgccactgtggctgttttctgccctccatttttctttctttctctttttttttttttttttttttttgagatggagtcttgctctgtcgcccaggctggagtgcagaggggcgatcttggctcactgcaagctccgcctcccaggttcaggccattctcctacctcagcctcccaagtagctgggactacaggtgcctgccaccatgcccagctaatttcttgtattttcagtagagacggggtttcaccatgttagccaggatggtctccatttcctgaccttgtgatcaggagcatgagccactgcgcccggcccccgccttccgtttttcaagaatactgtcgggacacacacaggtcagggaaatgtagattctctcatttcccctggtttttaacaaatgtcctttatataaaagacaaaacttgagatgttcaggctctgtctgaaactactggcctcttgcatcctttagataaaggacatttgaagttaatgctgggcctgtcatccttagttataccacgttggacaaggcattttatcttctggatcccaagttccatacttttcttttttttttttttttttgagatggggtctcactgtgttgcccaggctggaatgcagtggcacaatctgggctcactgcaacctctgcctcctgggctcaagtgatcctcccacttcagcctcccaagtagctgggactacaggtatgcgccaccacacctggctaatttttttattttttgcagagacggggtttcatcatgttgcccatgctagtctcgaacttctggctcaagcaatccacccgccttggcctccaaagcactggcattataggcatgagccaccatgcatggctatactctttaatgaggaagttaaacaagagtttaaaaatttttttttagcaacaaaaccattgtctcaaacaaagtcttaagtcactctataaaacagatggagataatatttctccatttgactccaactgagtaaagtccaagccagattgcctggcctccctcacattcgtccccttcccacacactgccaaggttcctgaagtaccccttgaaagcctaaagcttgttggaacccagtttgaaaaccaccagatgagataatatctcaggtttcttccagctttcagtagaatagaaaaatcattgactatggaatcagacctagattcaaatcctagttctgtcactttctaagctgtatgaccagactcaatttacccatctgtaaacgaaaacaaaaatagttctgctaggttaaaaagacatgtaaagcatctaggccagttcctgaaacccaggagggatttgtaaatagtagctataataaaggttatggtcctcacctgagcataacaaaatgagagatgatcctacacttgaactacaaatttgcagtaagatcgctgtcattcctgaagccgaatcctcaggaacttgaggccaaaattctttaaaacctgaattggttttaattgttccaaattagtagaggggggaaaattcttctaattcactgaacaatctgtatgcgtggagagcatgtactgcatagacacaccccaagtctcttaaatgacaccacggtcgatccaactagcacaggtggaatttgaagcatgttacttttaccaaaaaataacaggggaaatgtcattaagaacactttaatacaaagccacaagaaattcagtatctgacagctcatgttctatatttcaccccatatcataaaacaattcaccagagagcagttgttcatttgctgagctgctgttgtgatagcacatattatttcaataatggaggagttcctccataaaatcagtcccagaagccagtgatgtctgaaaaatctcacctttggagaattttcctggcattctgtaaaggaagttgcacttacaggtcctctaatgtgcagcagcaaaggaacaacagatgccaacattcttgtttgcctcatgaacttaagccctaaagtaagctgacttgagtaaagtttagaggctccccttcaagttttagaaaagctttcttgtttaacttatgcaaatttacacaccctcatgaacctattgcatatatccgacaaccgtccatattttagtaccatgtggtggctctcacctatgcccatatagctggcgacaatgcaggtaagatctggtcagctgtcagtttcattcagtgaatactcactgagcacctgctttatgcagggccctgtcctgggccaccagggagaacaacgcaaggttccaaacctatggagacagacaacgcatgcggaatgacaacagagaaacagagtcacacggagaaaagaggggaaattggggaaggcttttgtgggggaggcgggatttgaactgagccttgaaggaagtgggtgtgaggatgggggtatgagtaaagatgggaaatggagaattgaaaggccgtctttagagaatgattcacattataacgtgctggggagtaggtgaggcgggagggcgggatgggaagtgggaaattagtgtggagacagaaattgtgggctttgagtgccaggatgaggaatttctttgcgtgttgggaagcagtggcaggcgcaggacaggataataataatttaaagaaaatatgagtagcaagttgtgggagcggggagggaagcttggtgctcagaataatcagaactttctcagtggacccaggctcagtggaaagagcgctctggttccgtttattgctcccacagagaagagaggagagacccagagaggtttaaaattagaggggtcgacagggcacagggaactcctggccaaccatccttaggaaaacaagagaccaggaataaagagaaccagcagaagcacctggtctgagtctaagaaacatcagtgtttactaagcacttggtctctggaacgcctggctttccaaataccacatcttcccatccactccatcctgccacaggcagctactgtgtcgggtgctcagggagccggaaccacatgcctggaaaccctgagcccctgcccgccgccgtccaagccggccggctgcagcgcagtttgtttgccgaggtttgcatgcacatattcagttgcccttttttttcccccagtcctttcagccgtgtcccgaaattcacccttagtgtaacttctgcctctgctcctcctcttcttggaactgccttttgtttgtctggcagcgttggttctatgggggtgtgtgatgataataatacgcgggcttatataaccgtcttcatcttgcgagcacttcgcagaccgtcgctaatgaatcttggggccggtgtcgggccggggcggcttgatcggcaactaggaaaccccaggcgcagaggccaggagcgagggcagcgaggatcagaggccaggccttcccggctgccggcgctcctcggaggtcagggcagatgaggaacatgactctcccccttcggaggaggaaggaagtcccgctgccaccttatctctgctcctctgcctcctccctgttcccagagctttttctctagagaagattttgaaggcggcttttgtaagtatcgtgctctgcttttactttaaaaagaaagaagacaaactttccttcctgtccctgtccttttcgtattatttattcattattcatcatattattattcattatattctcagatgatggaaagtatgtttctggccaaagtcttccacccaaatttggtcccttgtaatgataataagaggggaaagaggtttctgttgataattaattcacttaacaaaatagtacccaggcgaggtactgaaattggccactttcacagcattctggtgatgtctggctgttgatacacaccacacacacacacacacaacactacacacacacacacacacacacacacacacacacacacacactcctttttgcccttaagaggagccctagtcacctggcttgttagacaaggagaaatgatgccactttggtcttcagtttctctgccttgggtactcacaatttcaatcagttgtaattgttgaaagtttcttttcacactacgaaataaatcccatctttcagtgcaggcttgaaacttgcactggcttgggtaaactgtacaaaacactgtagctatagtggacatgtgaatttttattaaatttttcactgcataaccgaaggttctaatattaaagaaacatggacactaactttttaagcacaggcaaaactcaaagccctgttatcaaactatgtgtcttaaagagtgctgaattaacagagtactcttctcagagattatgctcactgctttgagaaactgcttttcaacaagaggtgaatttaaaactctagaataacatgaagaaagacacaacttctgaatacttagcaactctgacttgctatttgaacaagccaaaaaacaaagggtctattttgggcaattgtacaatttgcatttataaaaccgtgattataacttggtatgctatgagatacagagatttattgttttaataagatttcaggtaagaaaactaagaactataaattggtaataatgtagaaaagcaaggcctctcacttttaatgctgtaagtgctgtgattcatttgtaaggctttatcatctttacctctagatgaatagatgtgaaaaccatgtatagtatgtatgtatatgttagtgtgtatatgtgtctttatcttaaattcttacatttgttgtatctatctagtgctcagtatgttatatgatagtacaacatccaaaatggatcaagtggagaaatttatttcacatcaactttcagattgcaatgtttattcagtatttattaacacacatgggaaatattataaaattatgtctttttttagattctctttaaatgatattttcccttagaattctctgtggctcccatgaaattctaaggtataattaaagtcaaaaataagattggattctagttgcttttacccctaaatttaaaagtgatatttcaacactaaattctatactttacctaatttgattacaaagatgaaccacataatctcagcattagcctcaaaggcaaactcaatcataatagaaggaacacaagctttgatgagatctggatttcaggcttagtttggtcaaactgaattaactgagccttgtgacacacacctgtagtcttagctactccggtgactgaggcaagaggatcgcttgagcctagaaggtggagactagagtgagttgcgtttgtgccactgcacctcagcctgggtgacaaagtgagatcctatctcaaaggaaaaaaaaaaaaaaaaagagagagactattgtagtgttccagtgagaactgctgggggcactgagcagtgtaggtggacaatagggcgcagattccagaaatatttagaaggtagaacattcttgactcagggctggatgaagggaatggaggaaaaggaaacttttataatattagttttgggcctgggctactgggtagttgtaatagaataccatagaacaagaggaggtactggtttatgaagaaaattgagttagttggagtaatatcaggttgagatatcactaagaggttagactgcaacgctgagtaaaaataaaaagcaatttttttaagcataaaattatcatctggatgtggtggcatgtgtctgtagtcccagctactcaggaggctgaagcaggaggatctcatgagcccagaggttcaaggctatggtgcactataatcaagcttgtgaatagatactgcactccagcctgagcaacatagtgagaccctggctctttaaaaaaaaaatgctagatttttgtctttgaaattttgaggagatacataaagactgagctctccctactatgttctaatgccccccaagaaatggtcactatctggactcaatgaaatcagagctttaatcttgtgtccctgctgccaaatgaatttttttctcattaacttttcaataggaagcccatgtctagggcagtcttgcctgtagctatgtgtatcctcaaagagagtaatttttacttcttcagagacttcagaaatgagcagagactaaagatctatgagctagtagaatacttattcataaaaagcacatatgcatgaagaagtaatacttatcaaaaacaaaccctttccttaacagggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagaggtgggtaacattcgcaaattttttaaagatgacaactggaagaattttaacattttgaatgaatagaaatcaatctgattagcaggcaggaagctgtgactttttaaatcttgaggtctgattacttgataaccctggttttcttataccctttcaccctttctgtgctcagcacttaatcttctaggcaaagcctctatcggatttcctggatttcagagctgttaccctacctgagcacttcagagcaaatgccatttcttataaaaggggcttagccccagactttatggctagtcttgcaaagtggtataatatttctttctggtacgtgaactgtatcaacacatttaaaaacagatttaaaaagctatttccacctctaaatataaagagccttaccacttattagaaagatagcatttgataacaatctgaatttcttccacttctgatggctcacttaattcaccaaactttggaaatcatctttgacttttgaaatggtgaaaaacatttctatttttgctaaaatgcttttgccataaaaaaagaagtgtcccaaaaaggaaccgttaacatctcagctatgcaaaataatcaccaaatatatacttttgaataagatgactgcatcatgggaaagttcattatttaaggaaggaacaagatatatttggggaaattcccattagcacaattgaagtatgaagaatatactgagcttccatatatggtgctggtcattccacatttaggttactcaagccatttaaacttggcttcataagcaagtactacaccctcacaatctttttaggttagccgacataatgatttactcccaactgggtgctgcctgagccactgtgctttgcctctgcagtgtttaaagagtggatagttcgcagctgtgaagttccccagacacctgagtccaaactgttgctggattttgcttctttctgtgctccatggaaagctggaagctcctcaactttctcttgggtttggcttcctgttcacatgttttctggccccatgtcaattgtgtatgaagtaatagtcccacatgcgtgcaccatccacgatggcaagatttgtgtggttcagcatgagttttctaatgagcacactttggaccttccaacaaccctttaggaaaagcagtttggaaccagttattactttccaaggtgacggaagctaaaacagaatgttcttttctcttttttttttttttttttttgagacagagtcttgatctgtcacctaggctggagtgccgtggtacaatctcagctcattgcaacctctgtctcctggattcaagcaattctcctgcctcagcctcctgagtagctgggattacaggcacctgccaccacgcctggctaatttttgtatttttagtagagacggggtttcaccatgttggtcaggctgatctcaaactcctgatctcatgatccacccacctcaccctcccaaagtgctgggattacaggcatgagccaccaggcccggcccagaatgttcttaagcaacaagactaaagccacttttaagagacaattaaaggacaactgcataggaaaaatgaacatttaccttacacatctgtctaaatgtgtgtatgtgtaaagtatataaaaatgcctccaattcacagtttaaaaatatcagttactgtttcagcattttgctactgatgaatggtgctagtgttttccactaaggactgttattttaatgacatttctctgcagcaaaatttgatgagtttacaaagtttcagagccaggaaatgcagcttgatttctgaacaacggggacaaccaagagagttaagttcaatcatctagttgctttatagcatggattcctaagtgctaactgcagtaacacactgacacagagagcaaagccaaaccaaactcttaaagtacagctgttaaactatcaagcttaacttctcgatatattctcaacaggtgaaattctggcacacacccacacttacttgaagatggtaatgtcaaattaatcaccatatgtccaacattttatagaattttagagtaagaagagatattggaggtcttccagttttaccttatcctttcattataggaacagaaaaactgagactcatgagtgctctctctctctgtctctctctctctccacacacacacacacacacacacacacacacacactcacaagcacacacacatcagagctgtactgagtcatgacttacagaaaacatcctaagtctgacttaagcaaaagaaagggatgcaatgatccacagctaggccactggcttcctggtcctttcaagtttgtgtggccagcttcagcactgtgggctgacaatttattattgcttgagaaaacattcagagtcttggagtctatatttttaaccaaaacttgaataaactctaaaacaaaccaaggatccatcggtgactcagatcctgactgtcctttacagtgaggctcagccaccttccaatagttactggggccacactgtgatcccataagatggagacaaagcccaagacacaaccctcactctgagggatcctgaaacctgaccagagagatgagaccatcctgcatgcaggccatagagacggtaaactaagtaccacactatgtggcacaggttttaaatgttatgagttctagtgacagggattaatgaaaatagaggctgtcagaaaatgagattttagctgatcccagaggggagattagagttttaatatgtggaggagagaaaagtggacttttccagataaagaacagaggagtgaaagcagagagaggactgtttatgggtgggaccccaaagaagctggcctgaggaaacatttctccacccacgcaatggaccatggagctccagtacagacttaaaattatttattttgagacagagtcttactttattacccaggttggagtgcagtggcacaatcttggctcactgcagccttgacttcctgggctgaagccatcctcccacctaagcctccctaggagctgggatcacaggcatgtgcaaccatgcccagctaatttttgtatttttagtagagacagggtttcacaatgttgcccaggctggtcttgaactcctgacttcaagcaatctgcccgcctcggcctcccaaactgctgggattacaggcatgagccactgcaacgggtcccagacttacattattatctattaaaatgttactgaaatatgtacccaaaaagctatgtataagttgttttatgtttgtatagctataaatacacattagcataattctatttatactattaaaatttcaaaataagtctctaaggataaacgaaacccatacaccaataatactctaattcatattaatcctctttgccagatgatgctgttttgctgaaactaaagaataaatttgttttaactaagtattcattaatgaaattggaaaaaacattttaacaaaaggaatttctattgcatattaagaattacacctgtttataaggaactgttacaagatggcacctatagagaagaaaggatccaggcaatcagtcctctggggtggagattttggagctgagaactgtgagggccaagtcatcctatcacccttctctattctgggaaacaaacaaaccttcatacaacacagcaggaagtatttgactctcacgtgcatacacatatcagcaggaacttaggctgcctctgttctttcttcaatagcccataacaattaaattattatatgattataccacacattattattatttatttttttaaagacattctagctctgtttcctagactggagagcagtggtgtgatcatagttcactgcagcctcaaacacctgggctcaagtaatcctaccgcctcagcctcccaagtagctgatattacaggtgcacaccaccacacccagctagtttttaaattttttggttgagatgagggtcccactgtgttgcccaggctggtcttgaactcctggcctcaagcaatcctcccatctcagcctcccaaagtgctgggattataggcatgagccacctcacctggcctacacattatcattttaatgatgagaaatcaaagtctacatttataaaatttaagaaaattctggtctcatttcatgaaaatgtcttttgattgcaaatatgcaaggaaggttgtatctttattactggtctaaaaaaaatcagtccaagtaataatgattgccgatgtttattgaacccttattttgtgctaggtcgtcttgcaagtttttcacatgaatgttttcatgtaatcctcacatcaaccctatggggtagataccattttaaattcccatttgtcagaggagaatactgaggcatagagaaattaagtaatgtgctcaaggccacatagccagtgaatgccatagcctggtattccggcatctcattccagactcagctgcccggtagcatattcagaacagtctcagaaaaggtattctttgacatcagactgtgccagcctaaccacagccagatacttttgacatcacattcagatgtaaactttcactgtaggagatcatgaggtgcacatacaattataagcacaaacatgtatatgtcctctcagaacatattttacaagtgggcatctgcatgatgcttctaataatttgtgatatcagcaccatggagacaggatggaaaagttcttctagaactccccaacccccaggaggagaagcacagtgaagcgagtgatctagaggcctaatgggtgaggtgggccacattgcagagggtggcataaaactagcggcggcggagtttcactgctgtttggagtggaaagaggggtgatgagagtcgtgtgggaggaaagtgaatcctgcagcaccaggccagctccaaggaggcactgctgcagcaatcttgtggtaggagtgatccatccagagcaaagcaaaggacctggggcttaacctgactcgccaaggccagctcaggataaaaagagattccaggcctatggagggaaaaaatctgcacccattacctctgagatccccccatatgtatacgaaggtacaactgtagtcaccagtggaaaagtatgaagactttaaatgaaatgctttattaaacattaatatttacatgggcatgatcaatattttttaaatgtgaaggaaattctgagttgttaaataagaggtctcatttccttattctatcttatattatgttctcttttatatcatatgcacatttacatacagtatgtatatgtcagatgttcatggcagcaagattgcttcatttgatacttaaaacattaaaatgggaatttcctcatattcaaagtgttcaaatttattttaatcacttacatttttcagctgtcaaaaatgtggaatataaacaaattttaccacttggaaatgcttactttgctagtcatcaaataatagcttgctgcaactttaaaagattccatgattcagcgcgttttcctttaaaataggtctcccaacctgaaattagacagcactcaacctttaaacttggaacactttgtaaacttttaaaaggaaactcttctttaatggttctatgaaatccagtcaaagaatgatatgaaatgaatctaatggaaagtcttttccttgttggagaagcagtcaaaatagaaacttctacaaaaggaccgaatcacccacaatgcttcaaagactcttgcgagtgattgtaagaaaatcggtctggatgaaatttagagaatattgttcctaatgatcaccccctttgaggctgtgaaagggcaacatctgaaagatgagaggaattgctgataaaacgtaactgatggcaattttgctcttttccatcgtaggtgctgacggccacccaccatcatctaaagaagataaacttggcaaatgacatgcaggttcttcaaggcagaataattgcagaaaatcttcaaaggtattcatcaaatttttatctctagcttaaaccaaggaccacctgggcactctatgtcacttgaagaggggaacatttcacggttggggaattgttaagaactggcagaaactgaaaagtcaatggtcctctaccttcccatcacattctcattcttgttgactgagagagctaaaaggggccttccacgtggtagagccatgtcacgaaatcagtcctaagaaatgtcagaagaaccatctgaaaaatgggaatctaaacaatcatatgactattgacatattatgagctgctcaggaaggaagctcaggggaattagggggcagtgtggtaggcccgccatgcacagccatccacaacatactccacagtgtcaggagtgaaagctgtacagatatctgatttattcacagctcgtcttcacagtttctttccttggccagataaacattagtgccaagagctttcatggagccagggagagttgtggcaacccatctcagcaatttcaccttggtggcaaaaacatttctagggtttgggttcatatgagggtacaacctcatgaggctttttcaaatgtcaactttgagagttgctccctttcacccctaaaaactaatgcaatgaaaatgttcagttcctctctatttcattagtcactcttcagaatcattgctatttgcttgattttttttttcttttctttttctttttttttctttttttttttttttgagaggaagtcttgctctgttacgcaggctggagtgtagtggtgtgatcttggctcactgcaacctccgcctcctgggttcaagcaattctcctgcctcagcctcccgattagctgggattacaggcgcctgccaccacgcccagctaatttttgtattttagcagagatggggtttcaccatgttggccaggctggtcttgaactcctgacctcaagtgatccacctacctcagcctcctaaatggccgggattataggcgtgagccaccacaaccagcctgcttgatttttattctaagccttccgttggcccaaggtggcttggaataagtcctgtaatcaccaaaactttcatgaacctcacctaaaaagcaacgtcttcaagtctggcccgaatttcaggtttgccttttgagggttgttttatccagcttctctttctaatacttatcgaattaaacatttttgccttcattctacaagtattacgtgaagaaagtgaatggttcaaagtgtataagacaggttagttctttgacataaagttataagcatcagcagtttttctagaattcttggagctttgtctgaagatggcatggggtattaacccccatggctgattacagcactgtatcagatgcttgtcataaaacgagctgaatccacagtaagagaagataagttgaaagttaggtctccttacttcaaagctctaacgtaagaaggaaatattctaaaacagtaacttcaaaagataaatgtttaataattcaatgaacaagttcattgaataactaataagttcaatgaacagaactggaacttctcaagagttatttatctcttgaatcaggttgtgaacaattttctttgtgaaactctagcctgatgcatcaatttttatgttggaaaaaacaaggttggccttcagtgccataccattcaaaattaaccgtagaagagactggaaaacccctgatactacaagagcacccttcatcttctgaagaggtccctgaggatctgatttctcaaagtatctttcttagtttctcttatgctatgaagaagccacttttctttctttccttttttttttcttttcaaaacgaacagagtcttcctttgttgccaggctggaatgcagtggcacgatcttagctcactgcaacctccgacccctgagttcaagcaattctcctgcctcagcctcccaagtagctggaactacagacacgtgccaccacgcctggttaatttttgtatttttagtagagacagggattcaccatgttggccaggatggtctcgatctcttgacctcgtgatctgccagcctcagcctcccaaagtgctgggattacaggcgtgagccactgcgcccatgaaaaggccacttttctacaatgccatgttgtttgttatctagctggtaatctttcatgttgcacttttctccccctaatgtgtgatttcaccactgtgttatgtcttcttcacttctcagcacatctttattatgggaaaatacaagtaagtgtctaggctgggcacagtggctcacgcctatagtcccagcactttgggaggccgaggtgggtgaatcagctgaggtcagtggatcacctgaggtcaggagttcgagaccagcctggccaatatggtgaaaccccatctctactaaaaatacaaaaaattagccgggcgtggtggtgcgcgcctgtaatcccagcttatcaagaggctaaggcaggagaattgtttgaacctgggaggcggaggttgcagtgagccaagattgtgccattgtactccagcctgggcaacagagcaagactctgtctctgaataaataaataaataaaataagtgtctaatgttggatcatttagattcacttgctcaaatttaacatacagaacatttttcttgaaaatctatggattctgtatgagacctggcttcaatctacttttttttaatcttggggctggaaaattcaaatttaatgtttggcttcagagatctctgccccttttcaaccaactccaggatttgagctgaattagataagcagacgagtcacttcccaccactacctctgtatttatatatccacaatcctccttctagtcaattttatggaaagaaatggatgtttttgggtatgtgcttggacaatcatgtttataaaatagggaccactttactggaccttagagtttcaaaatgctgccctgtgcatttttgattgcctctctgctcatatcatttgggtataaagttctttcatttaatattcagaactgcttacctgtagctcattgaacttggcatcacctctaaattacataacccaagagaaagttcaaggagatactataagcaaatctcagaagctgcccaagcatttcctgtctttcagattgccagattgtcccttgttccaaggagagataggttgtattcacatatgagaagacaccaaaaggacaattaaatttcacagcttgggggagattttgagggttctcatcaaaaatgtttacacctatggaacagattgcttttgtgtatgtgtgtgaagcctggttttcagcttaaaatacacctgccaaaatatgaatggcctttattgtaccttctggacactaatattgcactgttggacaaggtttggtgcgcacagatgggataacttagaacagcaactatgttgtttttgagaaaattaagatttttcctagccttgttaatacctatttgggatggaaaattttattataaggatggcttagctgtgcctggcactttatttttaatattattttaattattaagttaaatttagtatattaatctaaatgtaggtggtttttaaaattgcccgtagactgtaacagtaaactaaaccttttcaaggaatcaatatcagatgtggaccctaaaacttatccttgtcttgctttaagtgcatattggataccaagacaatgataatttgtcttgctgcagaatatagagacctatatttgggggtgctaaaaagtagactcttttcctttgtgattccccttacatattttgaaacatttctcattgaagaggacaatttattacacagaatatcaactcatttaaaattaggtatttgttgtaaaaaccatataacagtcgcttaagagttttttttttttaaatcacacacttaacccaaatcagttggtcttttctttataagtatatactaagtagaatcatagaaaattgcttctatttaactattgttggcctacaaaagcagtgatttcatagggtattatctaatattttataaaattggaaacatggagaatgtacaatgtttattgttttgttttcacctacctttgtgtcaaaacggttcatacaatttctgcattgtctttttagttcttttaaatttgtgcattgtgttccattacatggatgtgggacatataagttgctcatgctttttctttataagagagataacactaaacatacacacacacacacacacacacacaatcaatacctcccttcacgtagccattctgtttagttgcattttaatgatggtttttaaattgtcttctcctgcaccatcctcttatccctttgagactaatcactttcacatgtgagacttcaatgcaaatctaagtgataagcaaatgttagtatgtacaagcacacagatttgcacccatgtatgtacatagctaaatggatctgcttagaccacagtcctcaaagccagtgagcttatgtttaaagaaaatgccaaactccaattggatgagaaacattgtgcccatcaggctgtgccatcttttgcaggctcctctctcctcccatctgactgagacctgtcccagcaggtggctctgtcagtatgcttcggctgccagtaaaattgtgctttgcctgataatggtgaggaagcaaactccagagatgttgaccaacccaaggaaaactctttgctcttgccataatgatacattcaggcaggaagttaagagaaaaatagctcttcccctggcaaggaaaggagtttaattacgatgagggtggggactgggggacattcacaagtggatattaaggaaaaagaatgggatgatgtcattctttactgaggcagtcactaaaatgaaatcagctcacacaacaatggtcttgttctatgctcaaaagcgcaagttggtatgagacattactttgcggtgatgctctcaggaagggcctaaggggccgtgctcacatgaaactatttccccaaacatcttgaagacaggtcaagaagtgcagaatcattccatccagtgctgaaatggcccacactggaccatcatttgtttcagatcaccatgccacagtttaggatagaaaaagtgtctggattcttacaacaccatgaattcaaagaggcagaatatagtggttcaatctggtatcaggccagatgttttaaattggttccttttttgcaggataattttaaatggcatactgaaattaacatggaatatattcctcagtggaaggtttcaggaagtcacttcccaagaagaaatactgccttgtatcgtgctagagaatttgtagggctgattaattccacttacagaggaagcatttgatctatgttgatcttgagtccttagttccaatggcaaatattcaattttaggttccttttctcaatggtgtcctaatttgaccgcatttatctgcttagatttcacaagagtgcatcataattataaatgaagagtagactttctaagaagccattcctggaataattaggtggtggggtcaaatcctgttattaagattctgtcattattgcattaaatagggcttaaaacaaataagccattggctgaggccttttttgaggatatttttactgcaggaatatttataataggagaattgaagtactataggctttttacattggtatctgcagtttagagaatttgcaaaaaaaatattttttagtaagccactggtcttcaggtgtacgaacatattgagatatgaggtccttctctctcttgcagattacatgaaaatgtaaaaaaaaatggattacagtggaaattcatatttgttttatgattttgctctcaaattattcaagaaccttgtgtcataatctggcatgtaggggaagctgagatgtgtatgggacaaatatatttgaagactgctttggatcgtggccatcagaatgaaaagaggcacattttgaaggagtccttttttggcagacactaaagtaaacctcagggattcctgctacccttatttttaaaaagaaggtaattcagctgtggggtttttgagagaagataattattatttttttttttttgagatggagttttgctcttgttgcccaggctgaagtgcaatggcacgatgtcagctcacatcaacctccgcctcctgggttcaagcgattctcctgcctcagcctcccgaatagctgggattataggcatgcgccaccacgcccagctaattttgtatttttggtagagacggggtttctccatgtttatcaagctggtctcgaactcccaacctcaggtgatccacccaccttggccttccaaaatgctgaggttacaggcatgagccaccaggcccggccaggtaattatttaaaaataaaaagtaactaaaatatttccaaacaaattgtcagcaccatcagaagttctcaagtttccaagaaagtgcttaatattcttttctatttgtttattagtagcctttaaagaaatctaagttcattatctgcagtcagttgacactagcactgaaaatacagatggaattttaagcaaattcattatttacaaagcaaataagtgagtcctggtatctgacaatgggattcaccataaaattaattttaaaattactaggttttaaatttttacccgaaaatgatttgatgcatttttgcattaaaaactgtatttattacatgaagtataaataccccaggagattaaatccatcctgccatattcatgggagcctgatctagcccgaggtatgatgcccagcaggacacagtggccataggagaaaggttagcagccattcagagcagtcggtgctgtgctggaggcgttataggtattgtgagtatctctcttcatggtaagtagccataatataatgactcataggattcttctctccaaagaacactgtgctgagagtcaagatatcggctctggttttagtcatctaatttactctataatttcctacaaaattagaatgtacttgtcccatttccctcactaggatgtggtaaagaccaagaacataaaagcacttgtagggggagtagacatatgaagccactcaaacacaaccgattgttattgttgtaatatttaaaggataaggcattacatggtgatcattagttcccatcataactgtgctatttccatcaccttatttctctctcattatccttttagttttatgtctctgcctgccagtaaactaatcccaatgtgtattttttaatggttggcaaaaattcaaaaatgttcttgaaaagaaggaaggccatagaattgccaggattataactatgtattcagtgcattaaaaataaaaaataatataacaaaacaaaatagaatgaaaaatctttactggcttaagccttcaaaataaaagtgaaaaatatagcacatactgtattagatacttgttgttggaattcagctgagggttgacttcaaatcatctttaggattagaaaaaatttctataattaactcacctgggacatgtgctgctgcttttaatatttgttgattggctcctgttgggcactaaagtgactgaaaaattgtcatcatctggattccccaaacagcagccagagacaaaaaatgacatccctctgctcactgtccatacgtgtcatgaggctgcccttctcacagggaaatattcaattttctttttgccttttctacccccaagcactgacttatggaggaattttttcaaatgtcatatacagtatcagcttagtagtctgtaagtgctgaaatgtccctcctgggtaaaaggagaggaatgtagtttacatttctcatttgaaagtccatttaggttaaacagctttctggttgtgaaaatattaagacagagtttgtatgacatgacttgtgcatacatgtttgaacgactgttctagtgatagccaacctctaaatgtgacagacaataattctgactataaaaacattgattttttttctctgtaactcatgtagacagtaataccatgtatgcacctagttataactagctgagctattggcttttgtggatgtctgaaaatatatgcagtgatatatgtcagggtagtgcaagaaagagcccttcctaccttaggaagcctttgggaggcgttcaagagttatcacccacaaaagtgaacttgtcttctcaaaatgggaagctctttcttgtcctaatttagagagacccatgagagaagtatggtttaatggttaggaacacagatttgggagccagactgccagggtttgaatttccactctgccatttgctaactgtgacttaatttctttatgcttcagtatccttattggaaaaataggggccagtaatgccatcaacttcattatgctgttctgaagattagatgatttcaaatgtataaagggcccatacaatgcttaacaattagtaaagtgctttatgcacagtaactatttttatttatagaaattcaaaaatccagtaattcacaaagcagaaaataatgtttttgtgttgggttttttggtgggtttttttttgttttttttttttttgagacaaagtctcactctgtcacccacactgcagtgcagtcgtgtgatcttggctcactgcaacctccgcctcctgggttcaagtgattctcctgcctcagcctcccaggtagctgggattacaggtgggcaccaccatgcctggctaatttttatatttttagtagagatggggttttgccatattggccaggctggtctcgaactcctgacctcaagtgatccacccacctcagactcccaaagtgctgggattacaggcgtgaaccaccatgcccagcctgataataatgttagtccatatcatcattacacacacacacacacacacacacacacacacacacacacatattgtcaatgtatcaggtattctgtagaaacctgtctcaggactctgcacccaccctctggaaaccagtactagacaggagcaggacctatgcatgtgcctcacacataatagtaataacaataccttaatcttacatgtttaaaatgtacatttgcacacttgtgacacttattgagaaaaccaaattaagcaatgaatgggaaactactttgggaatatattatcagcatctgtacagatggaaaaccttttttaaaccagtttttaattttctaatttttgttttctctttggatttgtttaccctttggttcagatttttttctcccattcaatcatgatttgacaaatactaataaataacaactaataatcacgaaaatccgataaaaagatcctcctgatggagacttttaagattcagtgggtccagattctgagccctaactggctggatatttttactctggtctagcatctcccctagtacaacatcacagagctgcatgctgagcttcacgaaagagtaaaatagatctgcctcatcaaaacatctgttgagacttaattttttagagccatttttggttcacagtaagattgagaagaaagtacggagatttcccatatacccctgtcctcacacatgcacagcccctccattctcaacatccaccactagggtggtgcatttgttacaattgaggaacctacactgacacatcattgtcacccagagtccacaatttacattagctttcactcttagtgttgttttttctatgggtttggacaaatgtataataacatatattatcagaacattttttactggtttgcaagttatatacattcgatgacttttttacagctacaactataattagccacactatttaaatgatctaattttaaagctccaggttaaacactgcacagaatagcatcctgcccttctattttgccattattaagattccctcattgaaagatgaaaataaaattcctagagaatgatgaaaaaaagcatcacgaagagaagtttcctaagtattatggagatgtttcacacagcatagagcactaattctgcttgtgttttatatttttgaaaacaacactttatatttaaaattcaaaattcaagtcacatatcaaatgttgccataggatctcaaagtaacaaacatagtgttcggtttccctacttctctttctttgtcattaagtatgtgacagtgccaagggctggcaagtccctgctccaccaaagggagagtagaaaaagtgcctcttgagcgagtattgtagaccccatcagcccaccaacatctaccaagtgaaagttaaaggtgatcatcagcatggcctgaaatgaacaacagggccatggcttcttatatgtacagaatccagttcaaatcttttcaaagccagccaaggaccatcggtatgaggaaagaaatatggtattgtaaaaagacaatggagagactccaccacttaccagcttgtgaatctgggcaagccgcatgttcttttgggtcccagattgcctttctgtaaaatgtggataacagcatttacctcataatatcgttgtgagggactcaaagagaagctgtgtgcagaacgtcaagcctagagctggttggagagcgtataaccgagaagcattcatttttctcctcaccttgtcttagcacgagtgttctttcctccttcacctcccccctcttaacttggccctaacatatctcatcttagctaggttccccaggttccctacacaacaccccagactgctcttgcttcctcagacatacccttcatgggcagagccttgcaactgacataggccagaatacccttgtgccacacttatgaaaagctaaaatgtgataacctttgtaaaatattccttgatttccttaacttattattattaacatccagaatttatttctccctttgacctcttatggactttataccttaattatgattcatatttggtaccctactgtcatttatatatctgtgtttcacattagattctgtgtgtttttagactaggatattatctgtctatttattcttagatttagcacagtacttgcaggtagttaagtacacaataaatgttcattgttaatttaaaaaacaaagttgcaacttaaattttaaaacactgagctttgtgaactgccaaaaagaggcatccatgctttgacttgggccagtccccttgtggtaaatttttaagatcacctacataatttttcttctatttgcttatgtgtttgaatatctaaaagactcctgtggaaatagagccagaaataaatattgagaagaacctctgggctggcatctgtcttagagagtttagtgagaaatacagctacataaagagctgttgtgaaaggcaagaactccatggaataatgaatgaataatccccaaagctctttgccatacaccaatgtctcttaaaagtagcatgttacaaagtattactgtggaagaccatcaacctttggtcataggaacactacatagacaactttaagcctaatggtacaatcattcatggctaggaaataataagatataggcatcagaaaagccacatttgtgatcaggtgcctgaaatgaggtaatttaatttgaacaaagcccttgtgaatcccagggggtgaaaagggcacagccaccacctgttgtttcatcagctcaactggactgaaggacagcctgcccatgcccttggtgtggccagggtttctaattggacttccatcatttcagccacattacagaaaaggaaagaaaagattccaacagatgctaatagttgagagacaaatagtaacacacactcttaataagttttctgtgaaaaggctctaaaatgtatttttgttgttgtctaaaaagataatgaaaaggtaacagtataagggaaagtttcaggaggcctgagctttgtcccagctgcataactgactggttgtgtaaccttggtcaagtcacttaatctttctgggcctccatttctcatctgtaacatggaggtgctcactttcagcactgagattgctgactgaactctaagattatgcttttactgtattctaccccagattgtatcaccttgtattagtccattctcacattgctataaagaactacttgagactgggtaatttataaagaaaagaggtttaattgaccgacagttctgcagactgtacaggaagcatggatggggaagggctcaggaaacttacaatcatggcagaaggtgaaggggcagctgtcctacatggctggagcaggagaaagggagagagaagggggaagtgctacacacttttacacaaccagatctcatgggaactcactcatggaacagcaagggggaaattcacccccatgatttaatcacctcccaccaggttccacctccaacactcaggatcacagttcaatatgagatttgggtgggggtacagagtcaagccacatcattcttcctctggccactctcaaatctcatgtccttgtcacatttcaaaatataatcattccttcccaatagccccctaaagtgggggagtgggaggaggctgttccagcattaactaaaagtccaagtccaaagtctcatctgagacaaggcaagtcccttctgcctatgatcctgtaaaatcaaaaacaagttagttacttccaagatacagccagggtacaggtattgggtaaatgctcatgttccaaaagggagaaatcagccacaacaaaagagttacaagccccatgcaagtctgaaacccaggagtgcagtcattaaatctcaaagctccaaaataatctcctttgattttatatctcatatccaggccacactgctgcaagcagtgggctcccaaggctttgggaagttctgcctctgtggttctgcagggtacaacctcctgggctgctttcacaggctagcattgagtgcctgtggcttttgtaggtgcagagtgcatgtgttggtggatctaccattctggggtctggaggacagtagccatcttctcacagctccactaggcaatgcccctgtgggaactttgtgtggggactccaatcccacatttcccctccatacttccgtagtagaggctctccacagggctccactcctgcagcagacttctgcctggacatccaggcatgtccatttatcctctgtaatcttggtggaagctcccatacctcaacccttgtcttctgcacacctgaaggcccaacaccatgtggaagccaccaaggcttggggcttgcatcctctgaagcaatggtccaagctttatcttggcccctgttagccatggctggagttggagcagctaggatgtggggtgccatgtcccagggctgcatagaacagtggggccctgggcctggcccatgaaaccattttttcctcctaggtctccaggcctgtgattggaggggctgccacaaaggtctctgaaatgccctggaggcattttccccatcgtcttggctattaacattcagctcctccttacttattctgcagccttgaattcctccccagaaaatgggtttttcttttctaccacatggtcagactgcaaattttccaaacttttgtgctgtgcttcccttttaaatataagttctagttttgggttatttcttcgtttatgcaaatgaatatatgcttttagaagcagtcaggccatatcttgaacactttgctgcttagaaatttcttctgccagatatcctaaatcatctctctcaagttcaaagtttcacagatttctagagcaagggtgcaatgccaccagtctctttgctaaagcatagcaagagtggcctttactcaagttctgaatgagttcctcatctccattcgagaccacctcagcctggatttaactatccatatcactatcagcattttggtcacaaccattcagcaagtctccaggaagttccaaactttcactaattttcctgtcttcttctgatccctccaaaactatcttaacctctgcccattacccagttccaaagtcacttccacatgttcaggtatctttaaagccatgccccacttctctgataccaattttctttattagttcattctcacattgctataaagaactacccgagactgagtagtttttaaataaaagagatttaattggctcacaactctgcaggctgtacaggaagcatggttgggggaggcctcaggagacttacaatcatggcagaatggcagaaggtgaaggggaagctggcattgtcctacattgctgaagcaggaggaagggagagtaaagggagaagtgctacacacttaaaaaaaaaaaacagatcttgtgggaacttactcactattatgagaacaacaagagggaaatccacccccatgatcaaattaccgcctaccaggccccagctctaacattcaggatcacaattcaacataagatttgggtggggtcaaagagtcaaaccatatcatacctcttggatgagaattgcacctttcatttaagttttgtcaggaaaatgatgcaatgagaataaaaaatgaaaccataaataatttttactttatgttttcttattcaagctgaccctagatttatttctcaacaactgagatagaatctttgttgatacagatgtttctaaatagaggcaaatcctttgttacaaacaggcaatgttaaggatgataatttgtaaataaactaccagaggttctatattataatattacctagtaatattatcattgatattatatgttttacagatacattaaaaaacaaataccttaacaagcttcctaaaaacctaagcataaagtttaaagttttggtgggaaaagacatttcttgtgatagtctacaataccaaaaacatcttctcacctgtgcttatctctcctttaccctgctgtcttagtccattttctgcttccataataggataccatagattaagtaatttataaagaaaaagggtttacttgactcatgattctggaggctgggaagtccaagagcatggtgccagcatctggtgaaggtcttgtgctgcatcatcccatggcagaagggtggaagggcaagcaagtgtgcaagacatagaaagaatggggcaaaacttcttgctttaataggagcccactctcatgatagccaacacattcccacaataatggaaattatctgtccatgagggcagaactctcatgacctaatcacctcttaaaggtcccactttgtaataccatcacaatggcaactaaatttcaacgtgagttttgaatttaagccatagcacctgctttctcagcttttgtaagaagaataaagagtccttctttccttttaagctaattctgatgacatattcctgcttgaaattctaataagacataaatttaggaaccaggaagtaagggttttaggggagattaaaagacttgaggtagggaaacgatataaggttttatcatttaaaaggcaggtaaatgggtgggggcaaaatgaacattaatagcattgatggaagaggcccagtaagagttgaggttatcaggtcctggggacttcaaacagtaactatggggtgagttaattttaagatatgaatagaaaataagagaaaaagtatccagtaaaaaagaagtcaatagacagcaaagaggaaatagaaaacagtttctctatattttcatttttgttttccttgtgcatttctgcatcttcccttttcattaccacagaccacaatcatgctaacactgatgaaagaggaaggtgggaaactgataaatcctccaagtgattggcagaaggaagaaaaataataaatgcacaaataaatcaaagaaagttatatattttacatttatcataggcatatggtttgtatatttttgttatagaattaatcacattgcatttattaggctttcagttagttgaactttttggatctgtgaatttatattttttaacatatctgcaaacttttaagtcattatttcttcaaatatttttccattaccaccgccatcttctagtactcaagttacactgtatgtcagactagttgatattgaaattgttccactgagacagaattcacttttttattagcctttcatttccaatattgtacttttcagctctagaaattgtatttggttcttctgaatagtttccatttatctcttcattatgttcaccttttcgttaatatgctcgagcatatttgtaatagccacttcaatgttctcatctgccaattccatcatctctgagtctttttctcttgactaatttttctcctggttaggcatcacattttctggcattttcacatgtctagtaatacttaattggctgttggaaattgcaaatattacattgttgaatgcctagattttgttttcttattttatagaatattgggttttgttctggcaggcagttaattcacatgaggattagttgggccagaccttttaaaacttgtttttaagttgtgctaggtcagatctagaatgacctacctctcagactcattgagtcctactcttaaggcttgacctttctaaggtttctgcttatgtgtgttcacataaatgcctcatgtgtgatcaatgagttcttcccactatagttagtcagaacttgagggccgactggctgtgtgaagtgtaagttattcaaggtacagcccccagtaattgttctttggccatctttgtagtcttactctacatatctgtagcttaaatattcagcaaaggacttgaggggaccccatacagatttctggaactctttctctttatgtctctcttctctcaagctctgtcccacaaatttcacttcacttccccaaacacactctatcctcatctctgcttagattctcctctctgtgctatagtctagaaagtgtctctagtggagcatacattacttgtgtcccttctcttggggatcacagcctgttcaatgtctgagagttgcttcatatgtcatttgtccagttttctggctgtttatggcaggaggaccagtctggtaccagttatactatcataactggaaaaataagtcccaccacattcatattcaaactttgtttctgtttcttttctccccgcaaggcagtgagacccttcaaggcagtgacagggactcattcatctctgcattctcagtatctaacatatgaagcatagcatatatcaggcataataaatattattgaataaaagaataattgaccattgttaaaccaatccataatacttatggtatctatatttaagtaatttacatgaatatctaagtgcttctgtaacatgtggggtttttttaagcaactgagaataatctattaaattactgaatatatgtaagctagagatcaatgctagagtcaggttagttctatgctaaccttacataacattccttgtagctgtaagatgccagtgtccagaagcaaatatcatatgtgttcaggtatctctaggacaataatgacacgttattctagaataaaaagtagcagggctgttttcagcattcagtctatgaagttgacaaatagagtatctaccttcagagatttctgcctctatgcaagcaaaagggttaaaaactttcagactatagtttcatttatgttagtcttctaaaggactacggtggcttttaatttaaatagcaagatgcattgagttggtcttttaaaagtctatgcagctatcttctaataattaaaaagtagactcacaaaataagaattacagtcagactgctgtaaactacagaaattgggaaggaaagaagtcttgcattttcacattaaaggtttctttctgaaatcttaatacaacatctgtacaagaggtttcgtataagaaatatctgcatctggaaggatgaagtcttaaaaatctatgacgcttaaaatctgcggatatgggcacatctataattagaatacctgcacttcactgtttaaagagtccctaaaattccagttacacacacacacacacacacacacacacacacacacacacacacatcactgtgtctatttcataggtcaacacagggttcacacaatattgttattatcaatcacacagtcttttaatacataatctcatttgatccacaggattcttaaaattcccttttgttcctttttgactatatttctgtttttttttccaatgaaaagaagacttttttaggttaagaactcagctgtgaatgagatgtcaactctgttggttcattcttctagttaccttcagcaagtcaccttttcatctttgttctttgattacacaacctaccaggtagaaataataatttgatctccacatgagagttaagaactcctgaaattttaagataggataacaaaaaactggtgcatatgaagagaaatttttcaaagtaatgtttgtacttgtttaaaactaagcaaaatgacatttaaagaataatgatttaagttcatggtcccaaaacgatttaaaactaaaggttttatttcactgtgtttttttccaacatttccccctttggtttacatttgccagttaagaatttaaagtgaggctttgccaaagccttaggttccacctggtttggggttgaaaccacatgaagccactgaattttgcatagtttccatttgaaatgatttatcagcttgggttctctttcagtgagagccaggtttacatgaaacttggccaagcattagatgaacctgctctgagttttgattttatatcagaccctaaaatgaggccactcaacctaattctgtctttcaaaaagctcttcttataatgtccccagagtatacatagtagttactagagactgaggcacagcaacactttctttcagtataaaatgggggaaaatttctcggctgcttggaacctattctaatttgaaaactagacagatttaatagaggttctagtgtcaagcataacactttagggaaaaatttccttagaagtctcaacaaaagggttttcaagtaaatagctcagaaagaccaggttaattcattttttcctttattttttcctttatttatgcattcattaatttaataaatatttgttgggcacctactacatgcaatgccaagccctgttctaggcatgggatacattactgcacaaaataattagagatcccaacttttgtaggtcttccattctaatagcaggagacagacaataagactaaccacaatatacgtagtatatttgtactatgaaacaaaagtagagcaaaattagagatcagggtgggttgcagtgttaaagaggatttacaaggaaagactcattgaggtggtaagatttgaacaaagacttgaaggagtgaggaagtagcaaccagatcttgacgaagaatgttctagacagagagaacagctagagcaaaagccccaagaggaaagtgtacctatatattacaggaaccacaagggactattatgtcagaaatggaatgagcaaatgggagagtggtaggaaatgaagtcaggcaagtcacaataggctaacacattacctggaggccatgggaaggattttggctatttctccagatgaaaaggaagccacggcaggattttgtacaaaggaaacatacattccaacttacaagaatatataagttcaaaaggctctatctatcatgttgtgggtagatgatagatgggccaaggtaaaaaaaaaaaaaaaagaaacagtaagaggccattgaaaaagatgagtgctttagatttggtgatagcaatagaagtagcaaaagtagtcagatgctagctatttttttgaagatagagccaacagtattgcctaatcaactagatattaaaaagagagaaagaaaggaagacagagagagagacagggagagagagagatggatcatggacgatttttttttttttgagacagcatcttgctctgttgcccaggctggagtgcagtggaatgatctcagctcactgcaacctccacctcctgggttcaaacaattctcctgcctcagcctcctgagtagctgggactacaggtgcccaccaccacacccggctactttttgtatttttagtagagatggggtttcaccatgttgaccaggctgaactcctgacctcaagtgatccacccgcctcagcctcccaaagtgctggaattacaggcatgagccaccgtgctcagccaaagacgaattcaagatgctgtcccaagcaactgaaaggacagagctgccatcaacagagattagaaaggctgcagttgaaagagtgttggggagatagataaagagttcagtttcggaagttgagtttgagatgtctgttagaccttccagtggaaatatcattaattaggcagttagcttgatgagagcctatatttggaaataaagttttgcatttagaagtcattagcataatgtcaacaagtatgtgagtatagacagggaaaagcactaaagtctaaccgccgaaatactccagcattcaaaagtcaaagagaagaggagagaagagctccagtaaagtaggatgaagacaaatgggtggaggagttttgggtgccttggaagccgaatgaagacagtgtttcaaggaggagaatgttatcaactgcatgtggcagtatgatgaggattgaaaactgatcattggatttatccattggaggtcatcggtgacatgtataaaagcaacaatggtgaagtagagagagagaaagcctgattatttaggcaaagataaaatggaagaagaaaaaaacaagaaatatgacaactctttcagggagtttgctgcaaatggagcagagagaaggacagtagctgataagagaagcacagtaaaatatgtgtttaaataatggaagacataaccacctgtttatatggtaacacgagtgatataattttgaggagaagcatgatcatctgggtaaaaaagaagagtattgctggagctgtggttctgaatagatgagaagaggtagaatctggcccatgggtagaagaatcagcttcagacagagagaatatgcagaacctatctactccgatagaagaacatacgtgtagtggagtagatgctggcgggtgaacaagttgaggagttggggagacctgtggaagttctcctccagttgcttctatttccccagtgaagtataaaccaaggttatgagtgaaggtcagggaagagtatgaggagggatgaggtggtgtgaaacagatatttgagagaatggaagagtcgtgggattagggcaataaagtatgtttgcgaggcagtattaggacctctttgaagttcatggcactgaacataacatgagaccatttaggggattctatgttcttctccaggcacatagagttgcacaggtgcagatacggagcagccagagagctggatttaactcaagtttggggaaaccaagcaaggatggtgaagtgagagagggggaaggaggttgagaatgtttacaaaggactgatgataatgactgtcggtggaattataattcactaccctcccctgataaggaggggaattaagacatcaggggccggtgaaggagtgggaggatcaaggattgaagagccctgccttgtcaaaggattgttggggttggcatactaagagcaatgatcagagagtgggatgcatggaaccaagatgatggagcgggcagttaccagtactcataagggctagggttgattagattggccagggagtggcttggggagaggaggggtgatccagaaaggaagaggcaattgtgttcatgagctcacatccaagagctttgaaatcttcaaaaattcagacaggaagaaatgacagcgaagcaggagctgaaatcatttagaaattaggaacaacgtcctagggtcagtcaataactagggaagtagtaggctatgtaatatgataagattagagataagaaagctaagagatttgaggtggacaatagagagcatggagggagggagaaagggacagagaagaaaagcaggccggcaggctttaagaaagattttggcatgacactgattcaacggtatgttcatccattcttgccttgctataaagaaatacctgaggctgggtaagttataaagtaaagaggttcaattggcttacatttcctcaagcagtacaggaaacatggtgctggcatatacttctggtgaggcttacagtcatggcggaaagcaaagagggagcaagcagttcacatggtgagagaggaagcaagagagtgagcggtgaggtgccgtgctcttttcaatgaccaggtcttgcatgaactcaaagcaagaactcactcattcccatgaggatggcaccaagtattcatgagggatctgcccccatgatctaatcccctccaccatgccccacctccaacacagaatcacatttcaacatgagacttggagggagcaaaaatccaaactacatcaaatggatacactcacatttgcattgaatatcctagagttatgttattcaaagatagtatagttatagacaaacctgaataaatcattgcattttgtataaagttacagtttgccaaaatgagattcttcctccatcagaaagtatcaaggggccaataacatgctgcttcttttttttatagtgaaataaacaagaaaatccttagaaaggtgccaaatgatactgcagaaaaaggaatccaatttacacgtagatggtctaggcttactttatgacaataataaagcaagtattttctctaggaaagagagcttaaatctctgaagggcagtggatagctttataacgtataatactggctttattacccttttatggttttgcatcttctctttactttgacaaaagatcattcagaagtgaacttacttcaatgatacctgcacagactttatgcctacaaaagtaattcatagtatttatcctggtgacaggtcagaggagatgatcaaatttttttattttccctagttaagctatatttcattcttgatgccagagaagttttttttaatttcctgggaatcaggaatggcacttttggcaggttctgcaccaatctgagctcacagatgcccagaaattgctcaatggtactaagtctcctaagtaattccaattttgtagtgaaacaaattctattttcttttggaataaaatagagaaacagggccaggtagaatttccctggagtaagtttccttttcgtgtttatgaattatgtctttgcccatggtgagcagtggcaaggatgacagcaggtggctcattttacaaatcagtaaaccagaggaaaccttggtttgcaaggaagttgagtggggagaaagaatattcaaaaggaaaagaatattaagtagaggatttcaaggaattaagttcttgctcgttctttactacaaatagcaatataataaaaattgcaataaacctcccaggcacctaactctatgcagagtggatttcgtggacttcatctgaaatgacaaatctcaataattaattcaacaaatttcaatgcatgccttacatgtgcaggatattgtctaggcactgagactttaatggtgggatgtggcccacaggttccactctcagggagcttacattctcagatgaccacaatctgcccccgtgtgagccgaagttgtgactgcaagtgacaggcactgaaattcctggtgtgataatcggagactgcctctttagaggttgttggaggagggatgaagcgtctttagcacttggaacaaatttcttgaagctctttggtgtagtaacaccctagctctattctttggataggttttacacaaatttgagaatataatatattctctgaaaatgattagaagttaataatgaaaatgtgcaggatcctaagcagaattgtaaagtttggaaatataaattgctcataaccaaatacctggcttctgcaagaccgtgccagcttaaggacactttgtaccatagaagtatatctcaggaaccttctcactgaccagcatcttgagttcaacgaaacccctctcctatccagtcacagagctcttcttcagtttcctgtaaagataaaggacttctcccaaggccgttagctgtgtcttgatgcaaaagagaatttaaatttaaattctttttatttaaataaagatcattctattcttacattttcttttattagtcaatctgttcaaatgactgactttttattttattagtcaatttttaaaaaatcttccatttcaaaatatttgtctcctaaagcttatagaaaaaggcaggccaggcatagtagctcatgcctataatcccagcactttgggagcccaaggtaggaggattacttaagcccaagaattcgagaccagcctaggcaacatagtgagacagtatctctaccaaaaaaaaaaaaaaagaaagaaagaaagaaagaaaagaaaaattagtcaggcatagtggcatgtgcctgtagtcccagctacttgggaggctgagatgggaggatcgcttgagcccaggaggttgaggctgcaaagagctttgtttacactactgtactctggcatggaagacagagtgagaccctgtgtcaagaaagaaaggaaggaaggaaggaaggaaggaaggaaggaaggaaggaagggaggaaggaaggaaggaaagaaggaggaagggaagggaagggaagaaaggaaggaagaggctacttgagtttcactcgggttacaggattggcttcaagagaaagatagaaaaaataataatagactcttgtaagtgtctgaaagagagaattaatccaaaagtactttaaacactctagaaatgcaaataataaaatgtcggtgtgaacagttcttgtttggctttggctggtatctttttcttaagcactcccttccggtttgctgatagctctctatctgctttgcctaggatgacatccaaggcaggcagagtatacaaggactcttcaggacagataattgcatgtgcaaaagtagcttggattcagagcttcattttaacggttcgtaaccatattatcaatctgtaaaccgcatagaaacaaaagatgtcaagagaaaataacaggaaaaaaataacactagcagacagattcctccctacaaagtcttgtagtagaaaccaaaataatacaaaaacctgacaatagccatgtcattgggggcaagcggaaagacaaggtaaatgaccagtagagccagaggaaagaactagaggtcaggaagcacaaagggctctgcagagaggacgaaagacttcattccagatgctcaaagacagaggatggtggtgtcagcgggggattcctgggcagcttagggactaagcaagcacagggctttggtttacttaaaataccagttatgcgaaaaacagaattgcaggtgtctccacaggatgtatttctgcacaggttcctaagtaaatatagaggacagatagatagagtgaacaaaaaataaacaacccttatccatacagacttaaaggcttaaaaatgaatgagattttcattgtgtggtttctacccatttagtgtgggcaagtgtgtatgtgtgtgtgtgtttctttttctttagaattgcagggaaaatgcatgatgaaaaatgatgtttaaataaccaaattcctatgtgtttcactggctgagagcagagagacaaggagggaggaaatgagaaggagggaatctgtgaagagtttgactaaaaattgtcctcttccctcctccaatataatgcatcaaactaaaagaccagtttggagaggataaagtttaggttaaaaatgtgctatatgcagcccgtttctttctttcccaggaactcttttatgtccaactgcacagtctctatcttcctctaatccttttcagtctccttgccctttgcccccacaggacctttggcacattgcctcttgacctcaaaaaatgaggagttcagagtttcagggagattttgatgaaaccacctgctgttcttctctaccattttccccaccactgaattcaaatagaacggtagagggtataaatatgctaatattctgaaccacaccaaatccccaactcagcaattcctgtgagataggacagttgtagggatgggtttgagttaataattctcccaccactacccaaataggaatgggattggaagagcttgtagacagacgtggattccaatctctctcatatggaaaaagtgcaaaaatccaaattctcaaaagattagtcgacttagtattgtgctttgtagtcgagacacctcttgattttctcttacaaaacttggttttctttaattatgtactggtaaactctgaccagaaaactggaatattttgttatctaaaatttcgcttttataaatccaacttttggacatacaactcttagaagaaagggtcataccagtgtgtcctgagatagggcatcatttagcttggggaatgaaataagacaagcacagcatggcatttaagccattagtcctgatgagacatattcacagttggtcaaagcagggaagaaagcaggcaagatagctgaggaaccacagtgggtttgttgttgttgttgttgttgttgtttcaggtagtagttccctgtctgttttaggtttcaaatttaatttggaaaatgttttagttgactaaataaaagacacatgaattcacggatcatagaaaaagaaggaactatagcagagttaaaatgtttgggttgtgaaaataaattagtaatgaaaaaggaaatgcttattaggaactttctatgtaccagctcttctcctaagtgtattacatatacaaagttatttaaacctcaaaaagtctgtgaggttgatactcttactccagctttactaataaggaaactgagatccggaaagtttaacctgtgccaggtgtcacagctagcaaaggggcagagctcccgtcagaccccaaagcctgtgtttattgtaaaaccattatgctaggtgccaaaacaatgcttggatatatgaaagggaaaagaggtgatgttcttctaagaaagccattaggaaattcctttgaactatcactgatgtagctcctaaatttcagaacccctctactctctattcttatgaatcatcaacggttagcactacgttgatgctctaactacgacctctaactacgaaactgaatcgcaccttcagttgtttatgacattgctcttttttagaaacttattgtattaattatctattgttgcattttaagaaaacaaaatgtaagagacttaataataaacatcaatgctcttacacagcttctgtgaatcaggaatgtgggagcggcttggctggatggttccagtttaaaatcttttatgaggttgcagcctaagatacagagcagaccctacattgttctaagggacttactagagtaggaggatcctctcccaagatggctcactcacaaggctggcaggttggtgctggctgctaattggaggcctcaattccttgccatgtggacctctccatggggctgcttgagtgtcctcaccacatgcatggaaactgagagcaggtgatctgagagaacaaggcagaagctgcaaagtttattaggatctagcctcagaaatcacattctgtcattctgtaatcccattggttacccaggtcagccatattcagtgtgggagggagctgcacaaaggtttggataccaggaggcgagagtcactggagactgtgttggaggctgactaccacacttactgtcagtttattaatgatcctatttggtgactcggtctcatttttctgctttagggcaagaccaacagagagatgaaataaatgcagtaaatgcattcagttataattgcagtggacaatctgcccttgcatcttcccaggagagctagcgcttgaggagtctttctggactctcaactccggtcattctattgccctactgcttgcatcaaatgtaggatttgtcactaaacgtcaggctcaccaggatagtcaaacatcaggctctttgagcaaaaagaaaaagtaatgtctagggctaccctacatattcattcagttatctgaaaaatattttttagatgcctactgatggatagagccattgtctatgtggaatcttaggcataatgtaccattaggagggctcagtctgctaattgtagagattctttgctgaaatgaactttagagatagttaaatatagtcaccactccttattacaaataaaaacattgaagtcctcagaaaactaaaacttgcttttgttacttggttatgcctgttctgctttgacttctctcatcgataaaatcaccatcaaaaccactgcctaaaatgggttttagaggttctctctggatttcattgcttttcctctaccgtagtaaccagatgaactatttgaatgaattgtacctctttccagagttcagtccaagagtcataagttgtttatggacatcactctggtccttctgtcttagaaagaggaaaatctaactaaacctcaatactagcattgacctataactaagtaaccactttctatctggttagccaacatgtcaagttagacaactgtcctttccaaagggattgaagctgttggtgtcctgcacaagtggatgctgagaaggggtagaatggaatgaggtaaacaggtacttattgaggacctactgtactccagacagaatgctagcactttcacacctgggccaaccctttaatttccaaaacgatggcatgaggtgggaggcatgatgattatcccattttacaaaagagaaaactgagggtgatttgtccaagaatggttggggatcaagagacatatttgggatgtaaatccagatctgcctgagcctgtattctgacccactaagctgcccaaacaccactctgaactgacttctcagtgaacatgcctagctcatgcctgtgctctgtctcctctcattgtcccttgttgctttggaacactgaggtttaaaaactcttttagctttatgtttgcatatatgtgtatatgtgtaaatgaacagttttcaaatacattgttatctccttaataacagtatcccttttaaatttccccttccccacccatagggtggagtactatgctctgcccacaatgagctctgaagatagtttttgttcttgtgacagattttcaaccaagccaccacccacctctcctccacctcaactcactaagtgttctcttctgctggtggagaaaaaaataaatcatttcgaattttttaatatcatgttatttccctccaaacatgtatatattgtgcttctgcaaaaagtctttcttaaccagtcaatacatttgtctgctttagagttgtgatgacagtaattaatgtggaagctgaaaagtcagatttattatgactgagagaagtctctgcggataacctgtgtcttcacttaatttcaccacagaagtatttttttattctggaaatgttttttaaatgtaagcacattataatcgatgctgcttctttgtctttctctggaatttccaagacgaccttttcctctttgtttctgcttgtagtggctccacagctcagtatcaacacgggaaagagaggcggctctaagctgattacatacgcggccacccctctaagggcgaaactgcattgctgtcagtcttaggaattcacaaccttaacagcagccatggctcttcagcagaagccctgaggctcagttgccagctgatgacctttgatgggataatttctagctttgctaagactgcaagaggaacaagtgaggggttaggaagcaagagttattcatgaagccactgtgtctttattcaagaacgttgagaaacaaaccttcatggctattcttcgttaaataaagtagcatacccatttaaatttcaaaattgttcaagtcactcataaatcctcgaactttatctttttcatttaaaaatccttttttgcctgatggtcttgtaaggaaacaagtcattctatgtcttaaaatgattgtttcaagccaaaataggcacatgagaacattttaaacttcattgaacctcgaaagaattttcaatatttgaggagagaacccttcaattcttttttttttaaaggaactggacaacaatatgaatgtaatagatccattagcattgtgagaaacaggtcactaaccccccttttcattcccacaacaccaccaaatacttttctggttttaataactgttagaaaggtctgctcaaacacagaaaggagctagtgttttcacaagcctctgaaagaagaggatgcattgcaagatctttaaattcattgtacagcaagagaatgaaaaagaatgtaagaggaaagtggacaactacctgtttgacctatacatataatagatttgttactaattagaatcagtttgttttttgttgttgtttttaccatcttgaactttattaggtttatgattgtgcaatagatctctagaactcttttatcttgcaaaactggaactccacattcattgaacagcaactccgccctttccctcccatccttctctccctcctggagtccctggcaaccaccaattttactttctttcctatgaatttgactattctaggtatctcatataagtgaaatcatacagtaaaattattagaaccaatttggatacaaataagatttagatgtacaaattgactaatctggatgtactaatatcaagacaaacaaatgaaaaccaagtatggccacatgatcaagaacacttgcttggctcttattgcctctaatagttttctgtatgctcacttttgtgcaaaagctgtttaaaatccagcttaccgatacctattatcccagcaaggacagggttgtgttgggcagtggaaaatggtaaaacctaactctgaaggcccttggaccatttgttccaaaagcaaacaagttggaaagaatgtgagttttttatattttattttaagttccagggtacatgtgcaggacgtgcaggtttgttacacaggtacacatgtgccatggtggtttactgcacctatcctcaataacttaggtattaagccctgcaatgcattagctatttatcctgatgttctccctccctccgtccccctcccccagtgggccctggtgtgtgttgttccccttcctgtgtccacgtgttctcattgttcagctcccacttataagtgagaacatgtggtatttggttttctgttcctgcattagtttgctgaggataatggcttccagctccatccgtgtccctgcaaaggacgtgatctcattccgttttatggctgcatagtattccatggtgtatatgtaccatattttctttatccagtctatcattgatgggcatttgggtcgattccatgtttttgctattgtaaatagtgctgcaataaacatactcgtgtatgtatctattgtagatagaatgatttatattcctttgggtatataccccgtaatgggattgttggatcaaatggtatttctggttctagaactctgaggaatcaaaatgtggttacttttttacctccgatctgtctttattgtaatattaaaatcaaagacttgtagagaatagcctaaaatcccttaaacaaagttaaaaggcaaataatagtctagaaaaaaaatttgcaatgttcagtgctaaagtcaactatttttcctggcttaagggagttttattcttagcagttatgataatgacaaaaaacatgatatggaatgggaatgagaaggaagctgtcaatggtttgggaaaatattttgctaatgacttcattgagagtaacataatggaagttcatcctgggggctgagtactgtacattctgcattactgaaccctgaagtttgcttaccgaaaatacttgcaggaagtagctactaattaaataggcattctccaagaattggatgaaaattgaaaaattcagaaagcatttacaaataatttgtttaaatgtctttaatataatattacatctttatagtcaaatagttctttaagaaattctttcattaagatcactacattgtgcatggtggatatttttctgggtgagttagtattaactccgtctttaagagaattatttatatatcataagaaacaagaatcttatagtgcatttgaagaggccaactctgaagaattaggctacatttttagaaacatcaccaatcactgaagttttagaatatataagaacaagtattccttccaggaaggtaggaatattacatttcttctacttacatgttttattaccaattcacacttaacattggtgaagtaagcatgatctttcatgtatcacagacttcatttccttgacaaacgacttaattataatactttattccaccactttttttgagacaagatagcagtatttgaaggcaatttgagaagttggcaagcttacaaatttatgagcttatgaaatttatgtgttacattgatacaactgacgtcatacatattttataagaactgccctaaacatagacgtcatcattcataatgaattaatacttaaaggaaatttaaaaaaaaaaaattcagctaagagagtactgttttgatatgaaataatataagactttataaggattgttgtttaaaaacaagcaagttgtttttaaaattagaattttgcatgatatatcaattagaatgctttgggttgaaatagaaacttcagcctaaactgtcctaggcaagcaacaagacaatgtctgggctcacaaatgataattccagagaataaggaaagcatgctgcagttggggctgtactggagctccattaaggtcacctgttctgtttccttccctatctcgcttggctttgcctgctgtggagagctccatatttaggcatgtttaggcccttgtgtttacaatgtggctgctccagctccagcttcacatcttcacagcctgaagtcaatagacaacagagcactgacttcctccactgctcaaacaacaaaacctctgaagtgagtctcactggccctgagtgacctggcgttgggcattgatcagcctttaaaacaatcactcttgctgaagggaacagaagagaggtgcactccagacagtgtgctctatgggagagaggaggaggtgcaactattcctggaagtacaagggatagcaaagaggaaaaattatttcctcaaaacaaaatcagggacagttacaagaatagggtgcagctcctggaaaggaaaaaggcaaatagggcctctagcgttaggatgtaaggagtaaagctctaaccttttttctggattaatataaaatcttagataagatgagggtgccaactaaggagagccagtggggagcaggtattagaaaatgtatgccacctaccaaggaacaacacaaccaccctcatccaaagcaaagccataagaggccgggtgagatggttcacgcctgtaatcccagcactttgggaagccgaggcgggcagatcaccaggtcaggagtttgagaccagcctgtccaacatagtgaaatcccatctctactgaaaatacaaaaaaattagccaggcctgtaatcccagctactcaggagactgaggcaggagaattgtttgaacccaggaggcagaggttgcagtgagccgagattgtaccattgcactccagccccagcaaaaatacgagactccgactcaaaaaaaaaaagccataaaatccctgcaagcaatcaccagcacctcactctttttcatggtgaatgtcacttagatagtagaaacttcgatcaatttaatttgatcatgtactctttatagtatttacgctcaggtgttttgcgcagatcatttcactagtcttcatggtattgctggttaacaataccacccattgtctgtttggtgtcagtgaaggcttgtgtacctgcttacatgtgtaaattcacctggcagctcctaagaagggcttgtctagttcttattcaaacaatgtgtaaaggatcagaaagtaaatgttgttccctttcatcaaacatgccacagaaattaattttgtttatattttgtgtaaactccatgatcctgagtatcattagcaagttaaatcaaaaatagctgatatcttaccactactactatatatcagaagacatttgggctttctttgcagcctgttgtttgtgtttattaacatctttgattggcaagacattctgcttctaggtacatttggttggagggatggtcagagtgtaatctattagccacatttcccaggctaaagtgggctgcattttaaaataatcacttaacaaacataaaattactaaggatggagccccgaagcacagacacctaagaatattttcctttttcgaggaatccttggtatgttgattcactaatttctactcacttagagcaatgtggtagacatagctgctattttttaggccaatgtgtcgaactcacactctcataagcaagacatggagtggtaactgccaggaagtctggtgagatcatcgaaagccatgttcctgctctttatggccctcccagggaggaagggtggtgtcctgcagaaggacccaggcgcttgactgcctgagttaaatgccagtcccctacctactagttgtaaccttggaaaagctattcaacctctgtactatgatgacttcagctaaaatgggggaatgagtcctacctcctccgttttgtaggcacttaatgcatggttcctggcttatactctgtgcccagcaaacgtaagcttctatcattagcacctctgactcactgcacagcattaggagactctgtgccctggggagagagtgaaaccctccagctgggctttcagaacactctatttgtctctgctggtggaaggagattagctagcaaagggatttctgggcatccctgacagcatctggtacacagtagggcctcttagaggtttgttgaatgaatgccaggaccctggctgaaaggtgcttctcatccccaaggtatcaggcactttaagaatagtttcatacatttctttttaataacctcaaccttgtcttctatgaaatagagttcgattgccagaaactgtcattaaatatgcatgactctgttaagagattttttttgaacagcttttggtttccaagagtataccatattaaatagatataaaaattcttaattctaccctcagcatgagtgtgggcatcttaggggtaccccaagaatgtgaatcattcaaggggattcgtcctcatgactaagccatcttctgacactaaagttcaggtgtttaccatttttaccacaaagggggaaacagcctgcagaaacagttactatcctgccatatgtcaggggacactgaggctaatatctgcacgtttggaatgagagtgtgtgacatgcagtgctttgcacaatacaggatgacggcaacttttgactttcaacttctcgctttcttcactcattttcaaattcctcagagactgtcttttcagggcccttttaactgtgtgtctggaactgaaacagaagaaaaagagaaaacagaaaaataaaaatagaatagaaaattgaaaaaaaagtaattttctcaagttttataacatttcaaatcctttttttttttttttagacggagtctcgctctttcacccaggctgtcgtgcagtggcgccatctcggctcactgcaggctccgccccccggggttcacgccattcccctgcctcagcctcccgcgtagctgggactacaggcaccagccacctcgccctgctaattttttgtacttttagtagagacggggtttcaccgtgttagccaggatgtcaaatacttttatacttttttatatgtatacttttttttcaaggaaaaagcctgctttttgttttgtttgcttattggtttttacatttctgttgcctttttttttttttgagccattaagctcttgctcagacacatgcttctcatcccgtccttctatgcaatgccatgaacattaaacccttcagcagccgcgttcatttgcctgcagtcagtgactatcaatttggcttgagatttctaggttaagtgcagtaatgcactaaggccgggcccctttctggagataccagcctccaggagtctgccccaggtagtccagaagttgagttggtctgaaagcacctgtctggaaggcgagggggagtacttgctaatggtatggagaggtgcttggaaacaaagtgcagggcaaaaattagaccatgagagaaagtagaaagtcctgtcatgtcaaaccttccaacactatagtcttttttctttttgcaaagtttagcttattttcttttttctttttttttgtttttttgagacggagtctccctctgtcacccaggctgaagtgcaatggtgcaatcttggctcactacaacctcctcctcccagattcaagcaattctcctacctcagcctcccgagtagctgggattacaggtgcctgccaccatgcctggctaatttttgtatttttagtggagatggggtttcaccatgttggccaagctggtctcgaactgctgaccttgtgatctgccggcttcggcctcccaaagtgctgggattgcaggcgtaagctaccgtgcccagcctaactcattttcaaaacaaagtgatatatgccaggattgaaccctgtagctggatcccgtctagtgtccagggctgcctttgaaaggacagcagaggtccatctgccagtgaattcttcccactgctcagacactcgcctttgtcattcgacctgctgataggctgagggggctgcctctgagtggaaataccttagccattgttcttggaaagaacaacttaaaagctgagaaatggcttttagactgattgggaataaagttggacttccacaactttttacttttttttagtctaccgaataaaaatgatctttttgagaaaccagggctctgtgaaaaaggaaagtcttttaaagatgaaagatctcatgttatttgaaaaagacatttagatgtcctaatatttctcagattatactatgatgtgcaaatatgaaaagatcttgcgcttggcaattgctaactagatatgtagatatgactgcaaacaccaagggatgaggtagccagttcattttattaaatattttacatttgagttgaagaaatacccatagaagagaacattagcatctagacatccattcttctattccaaagtcaatgactaagcccctatgatgtaccaaattccaggtggcctctagagggaaaataactgtccgatatgcgcagggcattcctcgagtctcggggagggacagggaatttctacgatttctacggaagagaagtaagtgtgttcatggcagtgggagttgaagggaggcttcactgaggtctgaactttcttagggtataaaaatggtgtaaccattttggtggaagtggagttggttgggcagacagctgcaggttcatgagcccacaggtgtttttaataacagggctgttgtggggaacagggaaaagacatggttaggccagcatctaagaagattggtctggtacctgggtgaatttaagggtaatttcaggattaacagacagaaggcaaaaagaccattagaagccattacagtgatctggaaaagtaattataaaggcatgaactgtggtagtgatgaaagcaatggagaaaaggagacagaatcgagaagtattttgatgataaaatcagcaggataggggattaatcagatctcatgagtggagaaagtactgggataaatggaaagagaggatacatatggccaccagattcatctctctattcataaaacgatggttgtgccactgaatgagataaagacactaataagaccctaagtcacttttctttctaacacaatgacacggattattttctacaaatagagaacaaaatactagagtatctaatatttgtaaggcacttttgcatttataaaatgtttcactcattgtaagtcatttggtataattacaatgctgaaagacaggcagggctattatattttatggacgagaaattatgtttcacagaggacatctacttctcaaagtcacacagctagtaagtgggagagcagaaactcagattcagaactcccttccaaatccatccctccttccctgtagcaaggccagttcttttggtgaggagccatctccctgccaggacagagacaagctgtttctgccttggtgacagcgtttcctgccttcttgcccgggtttctgtaactagcactgtgcattggtgaccatggtcaggagtggatgttcttgctgtaggatcatattttagggctccacttgagatacatatgtgttataccttctttttcctcttgccacataaaatccacaaatggaaggccgatgaaaagtccctggagcaaatgtactctttgtaattttcacaagacctgtcaaattctagatgactgcaggcatttcattaaatgaagtcagtagggacttactaatgcctctgttaacttcactctaaactaacccaaattaacctggatctcaaaaatctggggtttcaataagaatttctaatcttgaaagcttatagcctttcctatatggcacagctgaaagattcctgaaaacagaaatttaggaaaagggaaagaaacaagcagaacataagtgtgggtttgggagaagcatgatggagaatggtggagcaggaaggtggtgggatttacagggaagaaaggataatgtctccaggcctatatattaatttcccactaaattcaatcagatgtcacagatggcatccacattacacagaaatatgaggttaaagcaaattgatatggaatggccctgcttgtgagaccggaggacaccccaactagtcttaacctaggcaaaggcaacatggcacttcccctgagaagtatgatggcaggtaagcctgccagtgtcgctgaaggaacatgaaagagcatctaactcccatctgtggcacagctaaaagattcagaaaaaccgaggcagtggaaatagtgaaatgcattctcacatttcatccccttgggtttaccctagcatatgatttgaggatgagggactgtaacaaatgcatcatatgtgaaagagaaggaagagaaagtagaaacgaaagacgtctgcttctaacagtgacatttttaaagcaagcacagtaatctctgaacatgtatttgaaagtacagatttcttgttcaaatagggtaccacagaaacacagaaccctaaaatgctcacaggtagaaaagctcaggaagaatgtctttgttttcaaatatttgttagggacaggaagccattaaataagatatgtgggtattgttagtgtatgacatatgggtaaataatgatgtttgttttctagagtggttactacaaaacttaacttcttaattaaaaaaaggaataaagatggaaatggtttaagctcagaactgtgaaggcaccaatttgtagatcactgaaaatatttgatcttccattctttctcaacacttcatccaagctattgatgggaaggaactggagagggagtggaagaggaatatgaggaaggtgtgtccttacttaaacttgaggcttactgacctggaattatacattttctttacagcgctgtcattcatttaaaggtctggaggataggcatgtcccctaacaccttcttcccagagagctggtgacatacagttatattccattcttcttcccataccttcctcattgacataacttctggaggtcactactgtaagaccttgagagttctgcatatgctgaagaatattggggagggcttcacagtgtttaaatatgtggttatgatggaagcagaagacatttcttcacaacatatgcaacttactcatctgagaaaattccttaacccgagacagaactggcttcagtgaaaatattcacagaacatgaaggaaactgctttgcatcaagtgcaatgtgtgtccccagtgtggtcatgatggagtgttctgtggtgtagcagaaaggtacgagatatggcttccttctccactttgagaaacagtgatttgggcttagccatttcacctctccgaatctgttttgacccccgagaaatggggataccaacagtgctgccgagagttactggaggatccaaattagaacaagtatgtgaaacctttgtacagtgtaagtttgatacaaatgatattatcaattacttgaggcctcagcatcctcaattttaaaataagttgaatacgatgacttctgaagtccattcgtgattcctgaaaacagaaatttaggaaaagggaaagaaatgagcagaatgtaagtgtgggtttgggagaagcgtgatagaaaatgacggagcaggagtgaagaggaaggtggtgaaattaacagggaagagaggataatgtctccaggtctatatattaatttcccatgaaattcaatcaaatgtcatagatggcatccacattacacagaataatgggggtaaagcaaattaatatgaaatggccccgcttgtgagaccagaggacaccccaactagtcttaacctaggcaaaaacaacatgggacttactatgacacgcatgacaaacttctatgagtctgtggttctgtgagatagagatttagcaaccatccaattaatgcttcttattgatcaaatcagactatttgtttttttaattactctaaaaacaccactgtatacattccatacttgcaaatatataaattaagcccctggttttgtttttgttgttgttgttgttgtttatttcttttaaattccagggtacacgtgcaagatatgcaggtttgttacataggtaaacctgtgccatggtggtttgctgcacctatcatccatcaccgaggcattaaacccagcatgcattggctattttccctaatgctctccccaacccccaccctcccctcacagaccttagtgtgtgctgtttccctccctgtatccatgtgttctcattgctcagctcccacttataagtgagaacatgcagtgttttgttttctgttcctgcattagtttgctgaggataatggtttccagcttcatccatgtccctgcaaaggacatgatcttgttcttttttatggctgcgtagtattccacaatgtatatgtaccacatttcctttatccagtctatcactgatgggcatttgggttgattccatgtctttagaagcccctgatttttttaatcatctgtgttcaatacctttacatcttttttttgacaaatagccacatcatttaggaatccttatagcccaattgattctctagactgtagcatcctagcatcactctgtgttggcagtgggccacaaatggatgacagatgtgtcaagatgtgaactacaggtgtaccaagatatctacctgctcagcctcaggatggctgggcagttctgggatggccagagccccttggactgtgagtggcctcatctgcttatcccagtgtgctgtatataatcaatgtcagtattttccatgacaggaaacactttgaggatcatagtctaaactaatcaagtttatcaaattatattcatttcatggtagttatgcataaatcaaattggctaaggtgtttcgatttacacattcatgtttctctttctaaactttgctagtttattaataactttagagtttagtaattactataaaatcagtttcacaagtctaagaatagtgtgttgtaatgtattaatttgagtttttggaatcctaatttgaggtataactgagacatttatacaaaacaaatgtttttttttgtttgtttttttgtttgtttttttttgagatggagtctcgttctgtcacccaggttggagtacagtgccacgatctcggctcactacaacctctacctcccgggttcaggcgattctcctacctcagcctcctgagtagctgggattacaggcatgcgccaccacagctggctaatttttgtatttttagtagagatggagtttcaccatgttggtcaggctggkctcaaactcctgatctcctgatcctcctgcctcagcctccaaaagtgctgggattataggggtgagccaccacacctggcccaacaaatcactttttaaaattcctttaaagcatagaaaccttgtttctttaaaaaatccytgctattcagtgaaggcagaattcctattttcaactgaaaataaaagtcctatttgcatgagtgagaaaggaaatggggaaaatgcctgcagatgaagacagataatcaagtttttcttatgaatagacatgtgccaacattcctgtggagttgtttttagtatcatctttgkatccaacttacaattttacatttaggtaagaaaatatagaatatttttagcaatattttctgaaaatactgaaattcttcttttggatataaaatatgaaaatccatcatttgggggttaccmcttaacctctttcaggaaaactcaggtagagtccaggtagattgcatgtgtgaagattctaggcttttcattgktgktgttttttaaagaagctaaagagcaattcatggcataataaaatatacttgaatcctaaaaaattataaaaagataaaggaattctttttttttttttttcatttctatggctcatgagagattcctaatattctttatttgacccagaaaccttaaactgcctaaaatattagttgagtttggagtataatgtctgttaagagaatttcttgttcccacttacctctatcaatttcatagcacttaccatatgttattgtttgtcctatttcaaatataaaccaaactcttctggtctgacgttaaaggccgtgttgtcctaacattttaaatctagaatggttgtagaatgagaaaaaacagtagggttagttaggagatataattgggtatttgactacacatagcaaaaaccaaaatagggccttattgactaaaggttttattctctcaagtaaggaaaattcagagtcagggcatcaagactggaacattagccactagggacctgagcttcttttctctctttactacatgatggagcattccatctgtgagaacttctcgtggtccaagatggctgcagaaacgccagtcatgacatgtgacaaatggacacccacactcttttatttcttttgtctttggttttttgggtttttttgttttgttttgttttgttttttggtttgtttgtttttgttttttctttgagacagagtttcgctcttttcgcccaggctggagtgcaatggcacaatcttggctcactgcaacctccaccttccaggttcaagcaattctcctgccgcagtccacgcccagctgatgttttcttttgttttgttttgttatgttttgtttggtctttttagtagagacagggtttcatcatgttggccaggctggtctccaactcctgacctcaggtgatccgcccacctcggcctcccaaagtgctgagattacaggcgtgagccaccatgtccagcctccacactgttttatagaactgtcccacacaatcctttcattacgtgtcactggaaagaaatcaaccttgtgggcacatagagttgctagggcaactaagaaatatcacctatagctggccactgcaaataaaattgggatcttgttctaaataaagaagacaatgaatgatgaggtaggcaattagcaatttgcatcacatcatttaggactctacaacagcaaaaaaatgaaaatgtaattgttttcaagaaatggtaacagaaatgagatgagttcacagtatggagaaaatagactgctgctatcagacaaaataaagttgtgccttatcattattgtatggaaaactattttgtcctctacatttatccccgtggtcaggcaaagctatgattcaagctgaggtgaatttccaggaatgcagcacattctgctgccctctccccgtgagtcctacctagaaaattacaagctttccagctgctgtccacaggaaagatgctaaattcccataaagcagtccttttctatttaaaattttgcgtttcatgtcaagcacaaatgcattttcagtagtataatcaatctaacttcctaatctgtttttgtaaaaagactttaaaatgttaaaatcaacgtatcttcaaggctttccttaaattattaatccttgagtgatttactctgagctattttgtagacatattgttaccaaaatcttgttcttcacatactcttttaaaacataagagtctattaagagtactctgagcaacatcataatgttgctaaaattattaggaagcagcattaacactttaactcactatattctcattactcgggaagtcattacctctttgtatttttactggttggtgggtttgtgcagaaagaataagtaaacctgaaaccaatattctagttgtgtgagttttgtgaaaagtagcaatgaaaaggtttgaaaccagtgcagacacagctttcctttgcttgtctgtacattatattagcttatatatttttgccatctatatccatgaatgatcaagttgacaattataaaacaacaagataaaaatggaaaataattgatttatcatggaaaatagctaccagccttggagtcagaagacctgagtataatttcaggttatgctttctcaagctactgtggcaggaggaggtggggtggggtgggggaggactaataacacctgctctaatttcccatgtaagttgttgtgaaaagcaaatttgatgatttataccaaaatattttcctgaactgtgatgccttgtgaacacagaaggaatcattttatccatgaaagagcaaatatcttcccctgggatttgagatataagaaaccacctaagcataggaaaaatctggttcacagttcaattattatcaatgtaaggtcaggctttcagaagataactaaatatgtgttagaggaaaatgctagttaggaaatagttgtgcactaaccaagttggaaacgtttgactttcatctaccttgactggcgaaaatggctctgtggggtttgttttcatttgaaaaacatgagcgctgcacaccactgtgttgttcagggtaatatcaactcacagagagtatcacacacaccccaggaagccctggggcctttcaaagtgtgccgtctgctctagctttagagtgaagggagttgccaacacattttgaaagtgtattgtacgtagcatagcatatgactttccattcaaaggcaggactcttttctcattatctcactagtgcctgatgaagtgccttatacaggtgctcaacaaagggttgctgaatcaaaatgtttctcgaagttagaataaatggaattgaacaaattgcaggtagtgttaatgcttagtcaaatatctggaaaaaaatctgttaaatatggaaaatggcaaagcaggagtgcttggaacttaatccagctcaatcttctctaagttcatttatctaacaccctcaaccagccagcaaaaacagggaaacacaagcaaaagcaagcagaattctaataaaccgatgatgcccccctacacaagcatttgctaccatgcccatacacaaaggacttgagagagaccctcacgtcttcattcttattttaaacatggatctaatgaggtctaacaagccacctcctggtgtctccctcatgtattattatagaagggagaaggtgggagaatactctccctagcacgttagaagacaagtgtaaacatgccaatgataactagaaatgatcactgatagcaaaggaggtaaaaacaatactatgagaagcatccataaggaatttcaaacaatgttgatctggtgtcatttatgtattgggcaaactgctttccacatcccagtatcacttagaaaaagtcaaaatcatagcctagagcactttggatgttaactttttttttttttttttgatggagtctcactctgtcgctcaagctagagtgtgcagtggcatgatctcggctcactgcatcctctgcctcctgggttcaaacaatcctcccacctcagcctcccgagtagctaggattacaggcatgcaccaccatgcctcgctgattttttttttttttttttgtatttttagtagagacagggtttcaccatgttggccaggctggtctcaaactcctgacctcaagttatccacccaccttggcctcccaaagtgctgggattacaggcatgagccaccgtgcccagacttggatgttaatattgaggacccagagccaaaacaaaacaaaacaaaacaaaacagtgacatcatctgcagtactctttaaagaccaggaaatgtataattaatgtttgaaagtgcatatgttagattttgccacaatccccaatgattgtcaccacctccccacacacatacacacacacaaaccagagaagtgaagggaaccaacatccccacccagggctcccaggagagcggaacttatacccaccccaccctgggctcgaccctatggcttgctttagccaatggcaggtcagcagatgtgccagatgccctgtgtaagcagatgttttgaacagcactcgcagtttccatcagcaatcctgctcctgccatggcaatgccatgcctcagcccaagtcctggagtgagaagagccacagcttggagcagcatggagccactgccccctccatgaaacagcaggagataacccttttttttgttgtgagctttaaagatttccttgtgcaaattccgtgtgctttaaaatattttatttttatttgcttgttttaagttggaacttttaaatagttcaagtaaggcagcatggaaattcatgtatctagagaccctcttttcccctactgtgatagataattgaggtattactgtgaatagcctcagttaaaattgcacttgagatggtgagaaaacagccacaagcagccaaatgcagtgtgttaactagattgtgcctcctgcaccccacaagccaggatgcctggcctcatctccttgaagttagggagacaagtcctgctgggggtgggttgggagggggatctcagaggatggaattttcatggactggggatattgaagatgatgtcactcattaaggtgtgggttaaggacagctttctgtttctggaaaagcaagcaccccagtactactcggagcctgagaatgactgactgcgtgactatgcacaaattatttcaccttctgccttgtcaccaaggattaattaatcattgcaagttgtctcgcgactccacaatgctaaatacaaatagaggagaccctcgaattcatggagctgtgactcgtggtcttgaatattcatttttaaccatgccagtgcactctctcacccagcaacaactctttgttttactgagttctgagggttccccttctgtttggaaggtgaaaggggggctgtacatggtgtgtggctgcaatactgatggcctgttttgttctcctggggagatactgtaaggcacagtggcagattcacctgaagctcatttttgccccccaaaatttctccccattaatttttccagtttgaaattctctaggcatacaagatcttttagagtgtaaatgcacttcaagagaaaatacaaaaacagaacacttatgaaggaagactttggtgtggtgtcatccccattctgcccttactgtgtaatcttgaacagatccctaaacttccctgaatctcagttttctcatttaaaaagaaaaaaaaatgagtgaaaatagttcctacttcattggtgtgtggctatgataaagtgaactaatgactatgaaatgtttaatattggcacatgatcaatggatattagcaaaaattcttgcttcttgattaagagttgagtgtcatccacgtcttggaaattgtgggaatttggaaactcaggagaacaaaaagaaaaaggtggaatggtgagggacttttggcagtcacggggcagaatggggctgtaggatctgaggaatgaaggaggagctggcgataaaatgagggggcgaggggaaaagggagcaaaaagagagaaggaaagaagaccagacatgaaccctttcggttgtgcccagatcccggcactagtccacgtggtgctggaagttactccctgaagtcaggcaactggaaaactagggctccaaaactgttttcccttctcaactgggtatcagaccacgtgtcccaatttggggttgctgtgataagaattgaggtagataaagtcatttggaaagttgcaaacatgaccttggcccaatttcagcccactgcacctggtccccatgattcatgccccacttttccagctcactttgtgtggccgcatccctttccctactcttccacagtgtgggatgaaggattcagctcagcattcccagaggcacctaatgtcatggtgtctttactatcatggtggtttgatacattttttggatcatattgtttaatcgattcgaagtttgtttcctactgcaactatattcacctgccactgtctcaaagaggaggctataggtgatgaaaggcccacagggggcgattggcagatacggctgaacagaattggtaaactgagtcagggctttatgaaaacaaaagccaagtaactcactctgcctccttaatctctggtgataatttaccttaagatggaaatttcagcctgggagtgttgaacctatctttaagcttagcagttgtttaatgaacataacaaactccagcattgctctggcccctgtcagagtccgttacttcacatatgtcaagaatttgagcaaccttactccttcagacatggaaagagagtacgtagaaagagatgttagctggtcatttgaaagccactcaaaagaacacttctggatacttgttgaaggaggtgaaggctctcccatggaaaactccttcagttgttgatgcctaggatagactgtatgttggcatgtttgccttcttggcaactctgggaagggtgatcgtaaacagtcctgtcagctacaaaataattggcgattattttgtagatagaaaataatcctatcttgtaaatgcttagctgcttcagcccatgcgaaggtctgaggagtcagccttcacggaagagacttgcaacacctacttgtctgggcttcacttttcctttcgttagtgctagtgggttgatcgctgtactctagaccagtactgtcagcatcagcatcacctgggaacttgctagaaatgcaattttaaggccgggtgcggtggctcatgcctgtaatcccagcactttgagaggccaaggcgggtggatcacctgaggccaggagtttgagaccagcctggccaacatgctgaaacctcgtctctcctaaaaatacaaaacttaactggacatggtggtgcacacctgtaatcccagctactcagaaggctgaggcaggagaatcacttgaacccacaaggtggaggttgcagtgagctgagatcgccgccactgcactccagcctgggcaacaagagtgaaactatgtctcaaagaaaaagcaattttataggtctcatcccagaatcaaaaatgctggagtaattaacaagacctctagatgattctgatgaacccctactccacgttatgaattaagtacttgagcctagggcctttatttaagggttgtccttctcttgcgtagctcttttaaagtgtccagtattctgaagttaggagccaagtgtggtaaagatgtttcttttgggaagaaaagcttcctcaaaatctaattgctagaaggaagtcagtaagttgtcaaggaattttaaaaaaatcagtactaagattatgactctagcctggatcttcatctttcttgcctggctttattctccaataaaactaattagcaatttaactatgcaaattttggaagatttctgatttggatttagtccaaatatgaaagtagtggtacataaggacatttttcttagtgaatttggaaagcattgatttacagtagtccagtagtcaaaatccctttgagccagatgggcattaaatatgctggcttgctatttgtgtaactacagttttacaggatttattgatccaatacttaaccaaccaatggccacattaaaaacaatcccttccaactctctcccataattaccagtaaaccaccacataggtatgttctgtaagagatgatttaggagatagatagaaacaatcttgaattatttaaatcgtttgttatgtaaaaaaatgtagaattattttgtgtggctcagaagaatacagcatgactaagcatctagaagagaggggaaggcagatttttgttcaataaaagggagaatttcctaatcttaaatctcaccctaaactaaacaggtggcctagtgagtcccttgttacctacacagggacactattcactgatgagtgagaggttttattcattaaaggttgatggaggtgaacttttaagatccctttcagactcagagattccacaaggtgttttccagaacacctccttcacattagctctccaaagtcaggcttgctaacctcctttctcatatatgatctcttccctgaagccatattccaaggagaaaaagcagaaagcagatggcctgcatgccagagcatcatttttgatgatttcacaaaaacagtttatgatcatttacatttatcctttcgtgtgtacttcaaggatatgctgtatgcaagagatcttgatatggagggccagacgcatgtcaaatccaagcctttgtgttttcaaccctgattgaaactaaatacaattatgaaacagaaacaaagatcagagagaaccagcaaattaagaaaacatctagaagtccaccaggactggaggcctcagtaaactttaggagccctggtaaactttgcaggcagccagacttagtagacttctattaatgatggcaactattaatattttgaaattgacaaatgttgttctatgacacatttcatatttcaccatagcgagccaagggaatgttaggcttcagattcacaactttataaagcattttccaaataaaccaagctcctcactattgttggaaatagttgctgtgtttggctaatccacccatcattgaaaactgttttagtttcccctcaatttttatgcaaattttatatataccctaatcaagagaacatgagtgcagtctttatttttgtttttccttaattaataaacatcatctatcttcctttctatgcaggatgttttagtaagcttgcaaatattattaaagattgcttttctttttgaagactgagatattaaaatcagcccaaccctgttgcactgtaatctctaatatcacatcaggttttaataaacctcctttttgcagcacacatgtgcttgagacttcatggaaaccaagtcagaagagagaagggattactttagatgactttaaaatatgcattgtttgaaatggcctctggtgaccagctttcatgaatggctggctttacttgtggggcccatcatccagtttaattatatcagctcctttgtgtgacaagtgctgttcttgcatatgctgagaaatgaaagtttaaaacaaagtagagtaatgagtgagaaaataaattctggaagtggaacacccctgggtgtttgtacggaagaattctaaggactggtccacctataaacatctatttatagagatactccacagtgacagtaagtgtaaatttgccttaaatgtccctggacctagatcataatatgtgccttttcaggaagatttattttacatataagtaacactttaggatgctaatgtggctcttaaaattttcattctataaattcttatgcataaaacttcataaaggttacttttttgtaacattagaataaaatgctaagtttttattagctaaagtatttcccaacttctgtccagccagtaaactaacacagatgtcataaagtttcaagacactacaggttcattatttgaatctataaatgttaggaaagttatggttttagaaatctcctgttgtatctcttgagttgttagcctttctaaaaaaaaagaaaaagaaaaaaagaaagaaagaaattggtgagtcgccgtggctcacacctgtaatcctagcactttgggaggccgaggcaggaggatcatgaggtcagtagatcgagaccatcctggctaacatggtgaaaccccgtctttactgaaaatacagaaaattagccaggcgtggtggcaggcgcctgtggtcccagctactcgggaggctgaggtaggagaatggcgcgaacctgggaggcggagcttgcggtaagccgagactgcgccactgcactccagcctgggcgacagggcgagattccatctcaaaaaaaaaaaaaaaaaaaacaaaaaaaaaaaacttcatacataaactgatctgcattttaaagtttccttgaaaatgtctccaagcaaaggcattggctttaataggatatttgatttttttaaggttctcctgtaagtaatacattttgaaaaaaaaatacagctaatctccataatttgccttgagctaggaactagaattgtcttttgaaatgtgaatgcctccttcacactgtttcccagagctttctttcctggtcctctatctgcctctgcgggaggccaagggaaggaggaaggaacttgtttccccactctgctgtgtttagccctgcaaagaagttagagagcattatattggcagtgaacttgatggcataggaagtaggccagtgggctgggcgtggtggctcacgcctgtaatcccagcactttgggaggccgggacaggcagatcacttgaggtcaggagttcgagaccagcctgccaatatggtgaaagcccgtctctactaaaaatataaaaattagccgggtgtggtggtgcatacctgtaatcccagctacttgggaggttgagaaaagagaatcacttgaacctgggaggcataagttgcagtgagccaagatcttgccactgcactccagcctaggcaacaggcaagactccatctcaaaaaaaaaaaagtatgccaatggggttctcttgactgcagcttcatttatatagtaaagtcaggtgttcctcttcctacatacgactgtgagatagtatttcgagaaatgattttcagatggtatatttatgtttcgaaaccatttctcgtagtacaagatagtgtttccagaaatgccttcaaaacataaatataccatctaattgtctttttaaaaatatttacttcaacttaaaatgtatctcaagaattgtggaactttaaaaatttttgcattgcgccagattatgtacatcaggaaaacagactaaaacgaaacatgtataaaaaatccccgaatctgtcgaaagtatatttttagtgtctaagaatgattgaactttatactgtgagaaagattatgtttcttcgttacttgagatatgtgtctgtgtgtgggtatatatatttatacacatatcttaagtatgtgtgtgggcatatgcacgtgtatgtgtgtgtgtggtatgtgcatgtagagaaagagaaagaaatggggtactagtgaaatgtaatgtttgtggcatagacattagtgctcagcaaacactttggtccactaaattttccagtgtccttgccgttgagtggggccacaagactagtctcatccaatgaaatgttagaagtgaactgggtcacttccaggttgaagccctgaaaagctcctgcacaattcttgagtttattcttcccttgcttcctggtctagttattgcagcaacaggacaacactgcccccatcagtgtgcatccatgcatggctgggcagagcagagttctctgccattctatgtgtgacttgcagtatgagtgacaaatatgcttttatcatatttggaatttctttgttattgcaacaaactacttctgctgactaatgcaatatctcaaggtacttcagtacaaataagccatagatatataaaaccaaaggcaaatttaatgaaatttaatgtaataaaccttatattttaagacctagctaagatgcccaagaccacattttagttctttttaacaatatcgctgcccttcccccaaacccactttatgttttttcatcaacttttattttaagtccaggggtacatgtgcaggatgtgtaggtttgttacacaggtaaacgtgtgtcatggtggcttgctgcacatgtcatcccattatctaggtattaagcccagcatccattagctattcttcctgatgctgtccctcccccaaccctaaagaacccccaacaggccccagcgtgtgctgttcccccacatgggtccatgtgttctcatcattcacctcccacttataagtgagaacatgtgctgtttggttttctgttcctacgttagtttgctgaggataatggcttccaagttcatccatgtccctgcaaaggacatgatcttgttcctttttatcgctgcatagtatttcatgcaaatccactttacctgaagtttccaatgcctcttcttttggaaatccagttgtctcttcgttctcattctcttggatctcactgccaccattgaaaccattgatcatttggaccacaattggtcaccaatgaccattattagtccctttagacactttgtaacatatgcttcaggaatactgagttcttctggtggttttcataatatctagatcactttgttttcctttgtcttgttaatttcatctgaaagaagctggacaaattttaatttggactttatgcattctctaaaatgcccttcggaagcttgtttttatatggttttagtacctgcttttatgaggcagagtctcaaaggcacatttctcacttcatccttctcactcttcaaccctcacttcatccttcccactcttcaactccatctattttcttcctccctgagaagacagagagaaaacctagaaaacttaagtttatttatttctatgttttgtaatgcaacagattattgaaaaaattcaatatatatatgaattaagccaaaaaataaaatctgtccctctccctcaccatacaccagggataaccagcactcaccactgtgtgaatagatgagctttgaagattccttccaatttcaagattcacagtgttgtgtggcaggaggagaggagaaaggaagatctcatcatttagccaaatatttccccacaggtgttccaggtcataggcatacacttttcagctgtcattgtttgttggaagaggatttattattggaggagaataaaagtgttactacaccaggaggggatgattgtctatcttctttgcttggagttgtagtaaattagaccaggaaacaggctttctggagattaacagtaggtgaacttgccagctgtggggttgttaaaagaagaaattagctttttcgtggattcatgtatcttataaagaagatagcacatcctgaagccttactctaaagaaaagaagtaatctctgggagactcaaaagccaaaattaaggggaaagggccatgttaactgatcctaagaaatgtatgtagacagcaatgtaggatgggaggatgagatgtgggtaccagcttcttgctggtgtaattctacttcgcttgcctctgacaataatctaagcgtgttctggctaaattcagcttcgcataactgcataatctcccctgcccctgctgtttcaactgcttatggtgtcccttttttctctggcctaactataaagtgccattgctttgtactagaaataattcttctgccccatccaagagaggtttatttctgtggcgagtgggttgttctgaccctgtcccttgcatacttcagatgcatgggcattcatttgtaaaattttgtgttatccttgggtaataaaaaacacagaattttatcactcatcaacaacttttatctgagaccaggcatttagaactgaggacagtttcaaggctttaaggaaaaaaagtaaatgagaagcttgtgactagggccagacctacagccttaaatgtgagagtctgggcttaactatagaacaaggtacactctaagccagcaattctcaaaccctttggttgtctcagtatccctttatataattaaaatttattgaagacccttgccccaacagtttttatgtggattataattattaatacttacaagtgaaaactgagaaaattttcaaatatttgattcttttgaaaataataaatctattatatgttaacctaaatgatatattttattaaaaaaaactatactttccaaacaaaaaaattgtgaataaattatgaattcattttacatttttgcaaatctctttaatgtttatctgaaaagaaggaagtcgaattcttatttctgcttctacattcagtctgttgaaatacactgttctggctgaagtacagtaataaaatccagaatcacatgaataagtagttggaaagtagaagcattttaatagctttttcagatacttatagatattttctgatactacaacaaaacttggcaagtgataattcattaaaggttagttgtattaagaaatctgaagccatatcaatgaacttttcattctgttacaatagaatccattggtcatcttgtacttcaaatgcattttttattcatgtaagattttgtagcactgtgattatttgggaaatttggttcactgaactatgcgaatattctaaatgttgactcatttcattttacaatatcaaaaaataacatttgttaacatcactaccattgtcatcagaaaaagttttacttattgggagtctgccaagtgtagtatacaagttttccagaattctaattttaacttgaaaggtagatttctatcattggtaacaaacactgtcaattgtttcccttgaaatgataggctcatttcattcattatttgagaaaatgtctgccaaatatccaagtctaaaaaattcttttaagtaaaagtagtgtttcattttttgtttgtttgtttgtttaaagccactttagcttgcagctcagccaccttcatgcttttcctcaagacagccatcatactcccccagccaccaagggactttgtgtgaacctcttatctcagaaaacacaacagtgaaaagaaaagatgtgtactcaaggtcaaggtttaataaaattagtggttttactgcttcatcttaagtgaagctgggttttttttgttgttgtttttgtttgtttgtttgtttttactatatgtgaagcttctatcattcatgctaagacaaaagcggaaagcggttctacctactattgcttttatgccatctgtagaaatgtcagcgcagtgaagaaagcaaataatgtgtcagtattcttatcaaaatagttctgacctcatgaacctctcaaaagggtcacagggtcctccaaacgtcccaaactatactttggacattgctgctgtggacaaaagcaaggtgcttttgatatattggccaccatcccctctagagacctagcaccaagctgcccagccaaagtggggattggggaagacagaggtccccttaaacctttgggagcaacagggcttcagtttagattggggtattgtggaacaaacatatgtgacctaaacttcctatccagttggctggacatcctgccagtcttttttttttttcttttacatgtgacttgaaacatttaatgccacttttatagtttggcttgacggccctaagccaccctaaacaaagtcttgtaaactttccacaccaattgaccataactacaactgctgttttcattttatggcttggagtaaaagcaacttatatcctggtcttgactggtgaagaatagaacactgttcttcaaactcactctgtatgtataagaaaaacctttctgcatttctttcattttctactctttctcaagataaattgttagtctctaaggactcttgttgtcccccacaaagtatccaattcaaacattgcatccttgtctcttctgtcaagctccgcattttgtctgtcaggacttttttcccttctttacttcttttccttctagagctggaaaccaggcagttaagaggatgacaggctttaaaaggtcatttttgaataaagaattgtctgtgtgcagtgtttctagagtggcatgttttgtgtgttttagtgaaggaaggtgagatagagagaggactcgtgctggccagactagtcaaaaaattcaattttcttgaccacttaatgtatatcgttgtaggtatgaattccctgaattgaatgttggtggtggtgggaagaagctgaccaaaagttccaaagttctagtgagacaggaggaataaacattaaagatctgttgcccagcaaggtgaccacagttaataacaatgaattaattgtatgtttcaaaaatgctaacagaatagattcttaaatgttatcactacaaaaaaaatgataagcatgtgaggagatagacatgttaattagcttgatataatcattccacaatgtacacatatatcaaaacatcaaattgaaccctgtaaatatatacaattatcatttgtcaataaaaataaaaattttaattaaaaaaataagatacactgtggcagaaaaaaatgtagatcttttctgcacctttcattcaccagaaaggaagttcatttcataggaaaaaaccactctctcttttccatattaggaaatgatttttgatgtagtttatacaaaggtatcattaaagctaatttgctttttcctaaaggaagaagtaaagtaaataagataaagaaaagaataactagcaatgttgattgggttccagcaaaggttatcagcatctgaattgtcaagaactttcagcttcttgtattgctgattatttaaactcaaatgccactgtttgtctaacgcagtgagcctgtaactgttcctacctggttgctaccatcagcaggggttcatttacagtatagtggatgcacaaaggccctcttcacaaactctcccttcacacacctctgcaggccttgagaggtgagcaaagtttttgctacttaaggaaccaacctctaagaaatttctgtatttaactatttagcctgacccatgctttgtgagaacaagccattgtttatcattttattactttagttttcctgtcccttcatgcctgtatcaggtttctcacgatttaaaacaaatgcacagaaaccaaacagtcagtgcagaataattgcaggctttcagtgttcagcatgtacagcaatcactgtggaatcaccctgcgttattaagaagaaagcaccaaatcttacattagtgacttctacagggctgcgttatcaattggagctgtcttgtttgttgcagataatgtagtcaggactgcctggctgcagacactagagttttgtttaaaaaccgatttcttcttgtctctttctctctcttgcagtataattacaggctgcagagtgaaaagcattagaactgtttacaaaacagctcataaagtttaaaataatggggatacgtgtgtgtgtttgtgtaaaacaaaataatgtgtatggtaggggtaaacaatatccagtctttcttctttcactaccccctgtcaccttccagaattaagggcatgaagttgagagatggagccctttcctcctgctatgcgatgcttacacttaattagttatgcctacttatccaatgccagtttattgttgcagatcaaaatacagattctcaggtgtatggggactgagtggctgatgaaacagactgctatctaattaattttagggcagcctaaattcccataaagatgttccctcatgacatatgagaggaagattttatttttttaatgagccctttgctatctttccaagagaaaagctttcagcaggttagtgttccaaagtgagaggggcatttttccaaccctttcaaaagcctccttctgtgcagctttgcaaagattttgcagctcgcccttctggattttatttatttattttttaatgcggaagggtagccgctgactccagcctcggggccaatcaatcattttgctttgcaggtttaagatctgtgacaaagcgaaacccctgtgctatctgtgccttaccagtctcaccaacaataagcctggtgactgacaatcgagagggggctctgtccacgtaggtgccggcacaagctgaggacatgagtgggacagaggaaccagccttgcacggaggaagcaccttttccttctggtgattgattgatgggggacagtgaggaggttttcagagactggaaaaaattgtcccagtcacttactatgaagtctttgtcagcagaaaagactctccggggtagagaatgatataatgcagatgacaaatgacaggtgtgtgtttcgttctgcttgctaggtactcagtatcacacgcaggtgagtcagcgctccccaacatgccccttgcgccatctgctccccacatgcaaacactcgttcccaacgctctgtggtttccctggcactgctggctcttcctaatcgatcgtcagctctgttggggatgtgtaaagtactgtcagagtgtgagcagggtgataccttaccacccttttatggagctgattatgaaatgaagatagcatttgaatcatttgttagcagttctgaaagttgtttccttctgttcctcccttttggagcacagaagaaaaaatatatgtaatatatacacatataatatgctgttgcaagagactacttcagatcgaaaatctgtttttaaaatcattgactgatatttcctttgtatttttttctcccccttccaggaccctatctgcagatgttctgaatacctctgagaatagagattgattattcaaccaggatacctaattcaaggtattagctctcgtcagaaagcttttacatttgagctctgtgttggaaattctattttggcaatgaattgaaataggaaaagttggaatgagaataaaggacaaaagtgaatttgcaaaataatcaagtgcttaaaaaactacccagcacttgtgagggtttgctatttctgactcatgtgcaaccctgtctctgccagcttatgtgccaatactgacttatttgtagccctttctctgcaactgtgcttggagtttggatttcattttagtctcaccgtctccgtttttctctgactgcccagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctgggtgagacactggactcttcacttgttagtctcttttgttcagatgatttctcgagtctcaggattatcaggagacattctgaggctttgcacttaattattgcacattaaccaacaccctagtttacgcaatgaacttgtattgaccataaggcatttggtttgtgtttcagcattacttttctgatgttatgcttttgaaatggtcggggaaggggcctgggggagtaggacaatggagaaagagggtcagcactgaagactgtagaaggaaaggattgaaagccctcagttaagacattgtaaaaatatttgggcaaagttgtttcaaagagtatgaggatgtgactgtaattttatgcaatggatatgaatatagactgatactaaaggaactttcagtggttattagtattagagtggattacttattcacagtttgttatagtaattgttaggtaattcaaagttgcagtgttctatatgtcttttggtagagaatccacttactactaccttagatatgatgcttttttatttagcttgcctaggctaagcgtagagcacccagaaagcctgccaaaatctagtgattctaacttaccttctatatcacctgactgggtttcttaccttctcaccgtcttcaatggcccagccctacggtcttgttcataagccaagggccaattcttctagtccacctagtgcaaggcagatagaaagcttgcccctagaagttgtcactaccactcctcatttcttttcctgaacccaaattccttgctctcaggcatcacccagctgtgcttagccatcacattcaacctgactggtagttgaatcttctagcagagcatgctgggcttctttaccgagctcctgaggctcaggttcttgaggataaaactcttcacgctggcacttggtctccatggaaggggactttgctttcccacttgaaaccagacggtgagatcccagtaaagttaattccttgggttcagctggaagcaaatgcgctaaaaagccagcagatgtcattattgctgacgttggtttgaggagtcaacccaacttttttttttttttaacaagggtattgattttcaggcgacaggccaaaatgaaaggtgtcacacatacatgagtgtgtatttagcacatatgatgttagtatgtatgtaagtggtggtttaaatgttttcattcacttacagagcaagtaattttagcttttttagagccttgtgggtccatttcaagttagtttagtgcctaatgtgttaatagcacagtctctgcatgaggattgcaatgttaaacatatccttgccctctgcttgacctcacacctgaactcaccttccttaatatctcacccatccatcgcttttgctacagctgagatctctggatcctctcatctttcccagtttttccctcaccggtttgtcacctggcctgcctgcctcctctagtcttggcctctcttgcccacccttcactcaattgccagagttatctttcaagtatctctctgatcagatcacttttctgcttaagtcccttctgtggtttccctttgccatgagattatgcccttctcctctgtgggcaaatgagttctgagccttgcggcccctgcctgtccccaaggctgtttccctttcctccactttcactctgtgcttcataaacacaattgccatctccccaaaggtgtctggtggcttcacccccctcgcctctatccatgcctttgcacatctcatcccctctgccttttcctctttccccacctggagaaaccctacctgttcttcataacccagttcatgtcatgcgcttggtgttcccaaaacaaaaccaccctcccctccagcagcattgatggaactttcctttgcaccccgagaacacgactccagcatggtgctcattccaccatagccttccatgcctgtcccttccacttgaccaagatcaaccagagagcaagggtgtgttttatgttgcactcctcatgcactcctagtgcctgggaatatagtgggcactaaactaacttgaaatggacccataaggctctaaacaagctaaaattcccagaaataaatataagtattcatcatcatctacctcttcaatatacagcactgtctttaaaatatattaagaaattgctcataactttcttttttaacagaattcaaattttcagccttgtcctatagttcatttattcatccagtaaatattttctgagcagttaccaagtattgccttctgttggaggcatgtgactatcatggtgaagggttatagaccaggctcagccaacccagatatttcctacatatttgcctttaactccttccttgattttctagccagataacatgctaagaactagctcattggctgggtgtggtcattctcgcctataatcccagcacttcgggaggctgaggcaggcggatcacctgaggtcaggagttcaagaccagcctggccaacatagtgaaaccccgtctgtactaacagtacaaaaattagccaggcatggtggcaggcacctgtaatcccagctactctggaggctgaggcaggagaattgcttgacccgtgaggcagaggttgcagtgagccgagatcacaccattgcactccagcctgggctacagagcgagactccatttcaaaacaaaaaaagaactagcttgtttaactctcacagtaactctaggaagtagttactattctctctttaatttaggtatgagaaaaatgaggctcagagaagtcatgtagcttgtggtgagcaagtaaattgtgaaacccagacctgtattagatctgagtctccacagctacgtatttaaccactgtcccttccattaatcagccatctacaaataattattaagcacctcctaaaaacaatcggcaaattcataatattttaggttctgggagagagggaacagaagcaaaagataggccactggcaaaaacaaaatgactaggaaccacagtgaactgtgggttggaggtccagaaaagacctcctttcttggcagaaaagtcatgctctcggtagtggttcccgcttgatggagacttttcctcatttttctgtaatgtgctcataatccttctagaacattattgctctagattttgggtgttggttgttttgtttttgtttttttaccatcttaaccatttttaagtgtacaattcagtactgttaagtacatttacattggtgtgtaacccatctccagaactctttccatcttacaaaagtaaaaccctatacccattaaacagcaactcccgtttctctctccctcaatcctggcaactatcattctactttctgtctctgtggatttgactactctaggtatcttatatgggtgaaatcatacagcatttatctttttatgactggcttattttacttaccctcatgtcctcaaggctcatccatgttgtaacatgtgtcagagtgtccttcctttttaatgctgaataacttttcattgcatatatgtaccacatttttttaacccattcatccactgttggaaatttgagttgcttcctccttttccctattgtggataatgctgctgtgaacatgggtgtacaaagagctcttcgagaccttgcttttagttattttggagctatacccagaagtggaattgctggatcatatgatactcttatttttattattttgaggaaccaccttactgttctccatagcaactcaccttgttacgttccctccaactgagcacaagtgtcataatttttccacatccatgcccacacttgttattttctggttttgtttttaatagtagccatcctaatgggcatgaagtgttatctcattgtcactttgatatggttaggttttgttttgttttttactccagtgcaattttctttgccaagtgctttaataaatcttcacctaatgcaaacctttttgcacctgtaatgctgtaggcaattttggctactgtgcctccaaaaagaaagtaacagacttagtaaagacttagaagaacaattatgaaaattctaatagaatacttttctcactgggaaagcataaaacaatcctatctgtttatctagaaagatgaaggctgagaagggctataatcaaagtttataaaatcgagccagggaggaaagtactagttcattatgagcaggagcccttcccttcactttcaggacaaataaactattactctgtaaagggagtaagacacataaggaattcattaataaaagtactagaaccttgcatatggataacactttatcttttcccaaagaacattttgttcacattattgtgaatgaatattgccatctcacatgagttgggtgggtaggacaaagatcatcatcccaggaggaaacagcctgtggaaagatgaaatggcttaaccatggtccccttacttctgaatttgcttttcccacaacttaagaagttgttcacgttgtgcctatacccgtaagtacttcagagttttaggctagaataatgggtggaagatttacaattttttaagctaagtaaacacgcaaggaagtgatcaacataaagttcaggataatggctaccactggggaaaaagtgatgaccgagagcatcagtacattcacattctatttcaaaactgaaaaaatatatatctgaaagaatataatcatgttaagttttgttaaagctaggagatgcgttatttattctgttacaccctacacttgaaatattttataaatcagaaggaagaaaataaaaaatgtttgagggactcctaactttctgagcctagcatcaaagaaattgggctctaaatctttcccaaatggcctttggtgctagtctgagaaacaaaatactgagcagattagaccattgatctgactcaacatggcatttcttacattcctaggaaattgacctgacaggaacatctcagtaacattgacccgatgtttctcttagatcatatgtatagggaagctatgagtacatggagatattttgtttctttaaaacaaaagccagaacacaagatattcagaccagagctagcccacagatgtatgttgtttgatgagcatacttttcagaattaagccaatattttaaaatcatattttaaaatatatataacatataaaaaaatcagattctgacgtttcttgaaaattcaaaaaatgaaggcttgtattcccatgaagcagtcatcacttggatgtttgaaggggagctgcagctgctctcggacactgggatcccccactactgtgttgtccctcaataacttatgccaaggtgcaggtgccatttatcattgaccatactgctgtttttcttatagtcaggaaaagctctataaaccatgtctctatcaaaggtaaaacaacaaaaagacacaaaaaccctctgacttttcttatacctggctgccttcacttgcctaccttatctatgtagccctgtaggcatgttaacttccattcctgtaagtagcttttaatggccttgtgctcttttggaggggccaggaggaaatgatgagtcttagtgatctggaaacattccagactaatttattatcttctcttttttcccttcttctcccaactaccttttccccctttggttttaggtaaaaaacatcttttttttttcttgccaattccatagtttgggtagaaaaaaaaataccatttaattttgttattttttatatgcttatgcttttagaattagaatattcaatagatcatacaggcattttaataaaggaaatgtcactgtttcatgtttcatactttactatgaaaataactgttggcatgtgaaaatggcagggaagtacctaatacaaacgacttaaatatttaaagcattagccttacttcatcataaaagaatgacatcgacaaacacccctccacaatcagtaagagctgggtttgcttgttgttgtcaatcttcaaaccatgaatgctctaatccacatggaagtatctctctaggaagccaggtgtatatgaatcccacatgtctgggatttccataagtgataatgacaatatttactgttgaatttctggttctgcgagtttttctggacatgacaaacaggtttgatgaaatttttaatgtttagtaatacaaaatactgtatactcaaatgctaagatatatgtatcgggaaaggtaaagctttgttttgaagtttaaacatgtcaatgaagtaattcaggatctccgtgtgattttagcaaagtcatccaaattagggggacattttctccgatcctttttcatacaaatgatttttgtatgaaatcattctgtatgaaatgattttgggaatcaagtagttggagtatataaagtgatttaaattcctcactatggttctgtctagccacaacctatcacatactccatccaaagcactattcctggagctttgatttttaactgtgccaaaattgccaacatggtggatcttgatggattcctgaagggtggcacttctcccactcccagccaccgctgacctcttcagcatcctggtccacagccgatggctgtcacagcatccgcctgcaggagcaatggaagatgttctcagtcccagcctggaactggggcactgggacagtgtgtcttggcagtcctgtggcctggaccttccctctcatcaagccagcccagtcagcagtgcatgcacaccagctacacagacataatcacggttgcttcagagcatttgtgtctggctcccacttcatgggacaacttaaaataacaatgaagttgggctttttgcttagggtgaggagtcagtgtgtgtagaaaagggaagaattgatatttgtatttgaaaaccaatatcaacattttaagtcttacagcatagaaaaggtagttgacctctgttctctcctccagcttttggacttcagatgtagattacagagaagaagatggaagaggcaggagaaaatttaatgtgatggggttgaggtgagcacatagggcaaccacagccacctcggcacactccttacaggaagtacttgatggcatcctgccgtttgctcagcaacaaccttgtaaactagtcggagtggggagcgctattagaagctccattttacagatgagaaacacaaaccaaaaaaggataaatgacttgctcaggctaagctgtggcaaaatccaaatgttttcccacatgttcaagtctagggctctttcccttctcatctttatcatcctcacccctgccttgtgaatctgattatgagtgttcagctttacaattcatatcattcctatgaaataattgttgtaataactgagaatcagcaccgtttgcatttcaggcacccaaggcctgaaacctacagaagtgaagagcttcagcttaaaacaaaactgagcccttccacttatcggacagacattgtcctgtccactgctctcaacagctgtgaataaataactatgagttttattacagaatcatttttagtaaggtttgccaataaaaaaatcaatggcacaatcacagtgggaatatatacagggtaaggcagtgttattgactgacattaatcattgcacagccattaaaaggtgctcgatgctttccttactggtacacactaacacagtggagtgaagagattcagattcctgcacaccgtcatctgtctctacccagagaatccatagagatcagaggcaacaattaacgccaccatggcagtcagcagctaaagacagacagatccacagcccactcatgcctcatctgtgcctgagccactgagaccatttcagccttgaggggagggtaggagacaggtgttaatgtcagtcagtatctcctctaagaggcgagaagaatcaaaagatgagagtgcagaaagagagacctatcgcgactgcaagcagacgtcaattctgtttctcatcttgaaaatgtcaatgtcacagccagcattcagcctagatagagctcaagagcatggtctctgggaagactgcctgcatttacttctgggttctgctactgagggtctgtgtggccctaggcacagcatgatttagccttctgcacctccatttcattatctgtgatataggaataatagctactagcacccaccacaaaggattattgtctggatcaaattaattgctcatgtgaagcacttagaagagaacctggctgagagtaagtagaaaatcgatgtttctttttcctgtctacaatataccttatagtcttggcagtgatctaagccacctagatcactcaaaattaggcacccactacagtctcttccagctctaggcttccctgattctgtgtccaacctagaatactttttcaggtgagattcactgagaggcagcttcggcttcacccaggtttcattagaaacacaaattctcaggccccatcctggacttactaagccagtatcttggggtgggtacaggattctagggcttattatgcccttcaggtgattttttaaagttggacaagcattgtctcagaatctctttactgagaaccttcaagccagattcccactttttgttttgtttttatgagacagagtctcgctttgtcccccaggctgaagtgcagtggcgcgatcttggctcactgcaacctctgcctcctgggttcaagcaattctcctgcctcagcctcccaagtagctgggtctacaggcgcatgccatcatgctggctaagttttgtattttcagtagggacagggttttaccatgtcggccagactggtcttgaattccccgcctcaggtgatttgcccaccttggcctcccaaagtgccgggattacaggcatgagccactgagcccggcccgagattcgcattttcaaggaccccagtggtggagctgtattcttaacagtgcctatggggatccactgttgtcttggttccttttgacgtgtggactggtgggagccagggcatctggagggattgcttgggagccctacacaatcagctcagttagttaagaaaaggatgatactgagaatgagaggagaatcctagctggggcacttccagcagtgatgaattgggataagttttagcccctgtttttatattattttgactttaaatcagatttctacctcggtcccatatttgtagtctaaatgagtctgtaaactagagattacagtgctgcgattcagaaccttggatgatggcctcagctgcatttttcttttatttgaattctgctaaggctcataaaggaaactgggagcttgttctttgaaatagactactggacactgaaaagccatcaacagggtttgctgttttccccaaaatcaagatactcagtaactaactactgcagagatctaaagaggagcaatgagacatggtagaaatcttcagtgtcacctttcaccctctttccacttctacatctccgttcatccacttatctccaggatattccccctgtgtgatcaaccaacacaaatataaaatgcaacatttctaaaatggggttttaaaatctcccataaggcatattcctttttagttacttcttcaccatcagtgaaacgattggtttccagttttcttctcacggtgaaaacttcaaggtgttagccaactcccagccttctcatgcatcaccacatcacttgggtctgcttcttagggtcgctctgtgtcagaggcatagtcgtccgagttcttctttcctcaggggtagacggcttcagcgacctcatctgcacccttcgtggaccagcagcagtgtgccctcctcaatccacacaccaccattgcaactgcaacgcctctcgaggggattgcaatccactgcagcagcaacaccttacaaagacttttttcttaacatgccgttcgtgtctttgacacagaacataactctacctttgttttttttattctatcacatccagtatctctgcccagccttcaagctatttgctaaatctgctttccacatttcatgaagagaattctccatatttctcttcatgccaggaaatcaatgtgttgttctcatcactctacttgtttcttcccacctccagagcatcacacatgtcactcgctgcaatcccccaatgatatacttcacccatccgacatttacttcctcctttttttccatctgtcctcatctctcatttcagaactcttattaagccatcaatccaagttccctctatttttatatgccctgctactgctgtattcacattgttacgtgtgcattgctttgcaaatatccccaagtgatttttctatgtaggttctcctctagagaatttattactgaagaccagaggcagaaaatttcccatttcttttgtttatgctacacttgggagatcagcccggaatgctgaggttgatagaatgttttgcatgaagtaggcactcaagacatgttattcattgactacaaaaggttgcttgatgccctgaagacaaccagaagagaaagagcagttaggattgctcctagccgaggcatattttagggagctctaatgagacccaattagaaaccctcctcctgttctcatatgcgtcatgtgaacggtaaaagctagtatatgaagacacggggctaactgtggctttttggactgttgcatgcttctcttctgccctgaatgcttgcctggtttgcattacgatttccttccttgctggaaaacatagactttcttcctttctttggaagaagtgggacctgttggaaatctgaggctccaagattcaaatgcaatgggcttggctgtagtgctctgtagtacacttcttgacaagtcctgaaaagactattgaattctggcctgtgcttttctgcagtgtttggatgtgtttcagctgcagtgtttggctggacagagtaatcgaaatagtttttttttttttttccttcctcagcaatcttacgttaccagttgatccttaaagttaaaatggaatattttacaaccctgcaaatactttcgagtgcaatcgaattatagctctttcacaagcaaacagcctatctttaaaaaattgtgcataaataggtcaaaatataaattgatgttgttatcctaatagaaaaactggcaaacatttggtgagcttgctagaggataccaacttgcattgaagatcttttttaattattattaaacaaacacaggcattttgatgggacttaatatggaagaaatttttttctcttttctttcatacgattaaaatgctatagtagtaatctacactagtaatctagtagcaatgtcactagtagattgcatttgtgctgggctgggggttttgatgctctgtgtatcaggctattgttctctggtaatcttcaaagggctgctggcctttgaatctgctccatatctaaaattctagctttaattatcagattagcctgcatttttttttcttcgtgattacagggaggagaagtgtatgtttattattctgcaaaatacttgagatggtaggatctcaaatgcttaattttgttgtagaaatgagagctgatcaaattatagactcctttaagctaaggaaaggaaatgaataagtcagggaaacagaggcactgaggggcacaatcgaaataggcattcatgtgctgcactttgctaaacaatgctggcactgtgcctttcagggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacaggtaagggatgacgtttctagcccatgaacgtcttgtaatatgtcttagactcaggaagaagtgtcatgtaatgaaatgcatgaagttccaacaaatacctaaaaaaggatcaagtgtttttaaactgcttgacatctaccccagggtctgggacacagtaaatgatcaaaattatttattatttattaattaatgaaaaactgatgggtaaatcaatcatgtgtaccttgttgattcatgtatttgttcattcataattaataggatttggaaagtttctttagcttgtggttgtttttaggtctcaaatgttcacttctaccttccaggaaaggaagtcatcctaattgctacacctcctattattgtttaacctacacagggcaagaagaggtttttgattaattggttttttgaaaattggggacttctttcaagaggggtagtgaacatcatgccagtctttctgagaaaaaagcaaggttccttctggtaatattagccccaaggccctatcctcccagcatgtagatgatgtccttgggttttttgtagcatttcttcataaaagggcacaacgttgttcgtagaagggctacagtgcagacatgggttgttgcttgtttttatttttccagaatcacctaggcttattcataagaatcaaatatgttatgattaaagcttgttcaaatgactttcaggcctacaatttctctattttgaagatttaaaagtaaaggagttcagataaatattctcctgcatctcttttaaaagtgaaattaatctttcccactggactcaggaaatatatggccatttgcttctttgcagagcgccctacgggcacttaatacttgttatttatggatgaaaatattgattgtgcatatgatagcactgtcactcgcagacagctcaaagtctcgactcgaagcagctcctcccgtgcatctcaagggtgttttcttatgcgtaggaaagaaactaggttacgtagaggttacagagagtgccttatctgagtgtgttttctcacattagtgatttaaatttatagcacctttcatttgaggactctaaagcaatttgcaaatccaccaaacatccctgtagagttcatagatggcaaatgtacttggctctgttttataactgaggtggggatttcaaatattgcgtgaccagctcagaaacagaatcagaggcggttccctaataaccggttcctgattttaaccatcaaattgtgttttgcttctgggaagtgttgtgtgaaatcagtgcctttcacctcccaggttccctagtagcaaacatggaactggaacgattgggactctcacatatccagagtgaaatggatgacatttgtcataagaaatagagattgagggtgagacagggccctgccaggacttagagcagtcaactagggtttgctaatttgtttcagggctaaattaggaagggcaagaaagaagggaactccattttgccattatctcacctaattcctagggcaatcttgaaagaaaggaatttcccatgttactaatgaaaaaaccgagactcagaaaggctaattgtctatggtcatgagctagtcggtgatggaatgaacccagcacatctgactccaaagtctttcctctgttcattgtcttatttatttatgtaatgattctcttctgcctcattccaaaacgccttccagagatacagactttagaagctacagacccatgaggaccctggcaaacagaaacaaagagtaggactagctaaagtcaaggcaaagattgctgtacaaactgcttgctgtggagttgtagggaaaggtggaatatttagaactaagcatccagatgttaagagcaaaaatggaaacaccatccattgtaaagttcacccagtcaccgggataaaaacaattcagttgcctctaagcatgtttcctggtacttgcttcggttatactgtgctatatccaccttaagagggattgagagagtttaactaaaactcaaagatgatttagttccatttccttatttttagaggagcaaatttacacccacaagaataaagtgactgaagtgacagatctgactgttttttatttatttgtttatttattttattttattattattatactttaagttttagggtacatgtgcacaatgtgcaggttagttacatatgtatacatgtgccgtgctggtgtgctgcacccattaactcgtcatttagcataaggtatatctcctaatgctatccctcccccctccccccaccccacaactgactgacgttccaatgggaagagccggcaccgggaccttagtcttcagggctctctccagtgtgctgatcaaaccttaagaatcgggtctgggatgaaactgtgtacacaccggaaggcttccctgttacctcaatggactgtcacttttttgtgcagcccgagaagtttgtttcagtcgatgtcttctccagggagagtagatttgctcctggaaactaaatctgtttctaaaccttttccccagggtttagacacttaggtaataatacaatttatagtgagtcaacctccaaaataaaaggaattctttaagggaaataaagacttttccaaaaacttagttaacagtaggaaaaggggctgggtgcggtggctcacgcctgtaatcccagcactttaggaggacaaggctggcggatcacgaggtcaggagatcgagaccatcctggctatcacggtgaaactgtctctactaaaaatagaaaaaattagccaggcgtggtggcggacgcctgtagtcccagctacttgggaggctgaggcaggagaatggcgtgtacctgggaggcggagcttccagtgagccaagatcgtgccactgcactccagtctgggagacaaagcgagactctgtctcaaaaaaaaaaaaaaaaaaaaggaaagaaaaaccagtaggaaaaggataatatgggctcaggaaaacaaatctagatttgcctattagtaaatcagaaaaaataaaaattggggccgggtgcagtggctcatacctgtaatcccagcactttgggaggctgagatgggcgtatcacctgaggtcaggagttcgagcctggccaaaatagcaaaaccccatctctactgaaaatacagaaattagccaggtgtgttggtgcatgcttgtaatcccagctactcaggaggctgaggcaggagaatcacttgaaccaaggaggcagaggttgcagtgagccaagatcgcaccattgcactccagcctgggcaacaaagcaagactctgtcacacacacacacacacacaaaaaaaaaaaaaaatgggaagactgaaatggcagtgatagagatctctataatttaatttatccttgatgggaaaacattacagtatctcagacaattaggaagtaaaaatgtcttcatgacaatagttattgatccaaccatggacaacaacccatttgaaaatacacaaataagtacacacaagtggcaggaatcttagaaaattaagagaattggtaggtagatattaaaccaatgtaattatgagacactaaactagtagggagaaagtcaatgtgtaaagattctattgctttcctaataatgaatttattatttggaacatttagctacaaacctaagaaaaataatgacggaaactgaaatatgtactatacatacataaatatccatctagagagtaagttttatgtagaataactcagagaaaacaaattactaaagggcttattttgggaggcgtccagaatccatggatttaaatgagttgaattaatccaatattatatttaccattgtatgacatgagttttctctttcagaactgaggcatatttttggactggctatagcctaaatttttctaagtttactcatggaaaatatgagtctatgagagcttgaatgttcaagaaggggaaaatgcagtaacatgtcgactgcacttcatattctgacaagtgaaataggaatgagattggattatatatcataaaaatgattatcctgcctgaaatcagctccaaaaaaattaacttaaatttattatgaggatatcaacattaatataaaacctggcttaggttttaaggtaaaaataattatccatggttgagtgatagcattaagtatttaacaacaacaaaaaaaactgaagcaagattgaaaacatcgtggaatcacattctaccttgatttgttttgaggacttggactggccagttttccaatctgtatgatgcagagattggcctagaatgattcctaagttttctttcttgtccaaagttacagtgtgttataactttattatactcatggtaattataatattgattcatttaacaattgtggtatttgaattataatcctaacacatggtacataaaatcacatatgagttaaatcttaatcacatgaattctacctcacatcactgaggtagaagggacaatatttaatagacagctgcaataaatatttttgtgaagaattcttttgtcataaatcaaaatcatagaccttagttctgaaaaagaaaaattatatcaaataatggtaaatacaatattggatcaaaaatttttttgtctttttacgttacaaaatttatgttacttatagcaagtatatttattctctaatatgagattttttaaatgtagagttcacttaaagtaagacaaactaatattcttaattttattatgatgtagattcttgatacatgcataaacatgagaaatgtcatacatttattaaaccacagtgtgcttggaacacactagacattgggatgaagacatttaaaggaagattcctgtcttcactagacttacaatctagttgaggaaaccagactgctgtatacaaactgacattaatcataattttaacttggttcaaaattatttatatttatagttactagcgtgaaatccatcaccctaagtctatcaattacgtggattaaaatctcaatatatcttttgatacattaaataagatttgacttttctgcggcatcagatctttgggttagtcactattgctggctttaaaagaaattccttggcttcaggtagttcctggaaatttttctaagcattatggaacaggttgtcctagacagaagtagcatggcctgaagccaacaataattacaatcaggtcttctgatctttctccctgccccccaacccccaccaccttcttaaacagctgtgaagggaagtgcttaatggtatccaaaacaaagaggatgggtaaatggcacattagtgatgtattcagatagtaggagttgaattgaattgccaatgccgaaggatagaaaaatattgaactatacgtaacctacatgtagacataatggcagtaagggcaagaaagctaaattcaccttaggaagggaaaaagagatttaatacatctggaggaaaataattagagggccagataatcaattgcagagcgccgccaggaaacatcgtgttgaaagaggccggggtgattacaaacgagtctcaatgtcatgaggcaacaaaaaggccagagcaactggaggccaacagtgctgcaccctgacacccaaggcccccatcagccttggaatgagtgtgatgggtgagcgcacatctggaatactgagtacatttcttacgctccgttaacacagagacaccaaaaacctggagggagttctgaagcaaataacaaggactattaaaagacttgaaggaatagtttataagggaaggattaagtcaaaggggaatgccatggcaatgggtagaaaacagtacaaaatatcctacaaagtaaaacaatgaggaaagggcaggaatgacttggggagaggaaacaaaaaaaccccaacaatgaagtaacttaaagtgcagaaaaaaaaattaaaactaattaagcagaaaaatgtaagccaaatggaggagtttgttgccacaaaataagtagtagtggggaagaaaatatgtaacctccgaagagatattttcaagtgcacaagtgcagaactctagtgcgagatttccttacactgcaggatggaaaatcatttacaaaagacagggccaaaagaatactgctaatggtgatgctaataacaatattagttgtaggagcacttaacaagccgttgttttgtgccaggcactgttttcagcgctttacatatgtgttgatgcatttaatcctcaaaacaatcctgccaccattattattatcaccatagtggctttgcagaaggggagttgggggagggagaagtgaagtaacttgcatgtagatggataccctagcaagtagcagagccagaatttgaacccaagcaggctggctctagggtttatattctcaatcactatgctttttgccttcttggaaaaaaaaaaaaaaaaaggaaagaaaagtgggataaacccgtagggatgaggaggaggccaaggaaagcacggggcttgaggctgttaagtgcaagctttttggaaacaatcgcttttgaacgttagtggggtgtggccttggtctgctgcctgtggctccaagtcatactgcattttgttggaaaaggaaaatcatcttgtggttctatgtgaaaaggtcagttcgtctctaagacaggaattcctcattaaaagaattccaactacacgtagtcagcacagaaggaaatcctgagtcacctgatgtgagaccctttgacactttgccctacactgatcaacgtgctcagtgcccctggcagaatgcttaagcagcgggcacttggctgactgtagacctaattggttcactcattcacagagccaacaaataaacattcattcaacaaacaaacattgccatgtttctcagactggagtctagattcttttaaaaataatataataagaaataacaattttagaaactctaaagctctattctatgaaaatgttttgaaggccaaatcagctttaaaaaatatgatgatttgattgggcgcagcgcctcatgcctgtaatcccagcactttgggaggcctaggcagatggatcgatcacctgaggtcaggagttcgagaccaacctgaccaatatggtgaaaccccatctctatttaaaaaaaaaaaaaaaaaattasccaggtgtggtggcgtgtgcctgtagtcccagctacttgggagtctgagacaggagaatcgcttgaacccaagaggcagaggttgcagtgagccgagatcacaccactgtactctagcctgggcaacagggtaagactccatctcaaaaaaataaaaaagataattcaagcaaaatcacaaaatttttaaagtctagacctcgtaaagtccccagaatacattggattcatgaacccaaattcaagaaacaaaaaggatggagccctgaactgtgtgcaaggatggagagtgcctcagagataaggcagaggcaatgtttgccctcaaaaagcttacagtctagcaggtgttcagcttctatatgaacatgactataccacaatggagaaagggaagatgacattacaaccacaaagacagtgttgtggaattaagacagagactgtgagtgaaatggcatctgctctggccttgatatataaagaggcaaataaagagaattgcacaagcaaaaatagagaggtgggaaccagagagcaaatagaggaaacattagctggagagagggacgattaacagagaaataggagatggggttggaaagggaaggattttgtccaaactcaaagtaggcctctgagggcaagctagcagagtacacttgattctgcaggcaatgagggtaatctgagattgcgagaagagggtgaagtaaccagagcaggtccttgggaagattaaccagtggcaatcgaagtggaaagaccctccatcctggctgggaaagtcagtgagaccatgagcatctgtgaggggtggcaagttaccagggatggcaggagggatttgagcactatttccaaggcagacctgataggaggtggcaactgcccagcaaggggagcgcaggagcaggcgaaagcagagggggctctggagggccaagcatggttcatggagggtgattatgccattcagaggaatggagtaaggctgaaagggaaaactggtaattccattttaggcaatggcattaggaagcaagtaaaacattcagatggaggaattctacaggtacaggtgctccttgacttacgatggggtgacatcccaataaacccatcataagttgaaaataaggtaagtcaaaaatgcatttaatatactgaacctaccgaacaccagagcttagcttagcccagtctaacttaaaatgtgctcagaacacttatattagcctacagttgggcaaaatcatcgaacacaaagccaataggcttgtaataaagtactgaataactcataggattgattgagtactgcactgaatgcataccaattttacaccactgtaaatgtgaaaatcttcaattgaaccatcgtaggtcagggaccatctgtagtcgtatatcaaagataaaagcaagctaaatacctatcccatagagacatcaaaattatgtacatcattaagtttaaaattcagaatgtgtgttttaagaccaatgtcaataaagtgctgcaattctagaattcgtttctattatcccaagccagtcttccaggaactacttttttaccatggatataagcgagggcacctataaaatctgtttaatgaagccaggcattggctttgacatggaaggcgtctggcaacagctttataacatcagaaaaactaaaacttgcctacatatgtatatgcatgcataggggtgtgtgtgtgtgtgtgtacacacacctatcatwatatacatacacgcacacatgcttatacctatacagacatatataaaataaagttttctctagccctttctacttgaagggaaagctatgtgtgtggctggagtgactaaacatttaggtttacccagaatcatgcttgtttatacctgcttttctgtaattacagcaattacaaataacatcctcttgctctctcaaaagtattccagtatatttatgactaccattctgctaggttgtaatgtctttttcacttcaagaatgaacccatattgttcctggaatcccagcttcttctttgcttcccgtacccctctcctgtcatcatcttttgcagaagaccaaatttctagtcaccctctcagagagaccgagtcagccctgtggcacagtggtctttcttggaagtgacatgccaaagttataaatgtgaaggccttccagtggcttttttagtgaactgtggtgtctttgtgacacatacacttctactatactataattgtatgaaaattagtaatctatgtagtaactctatgttgacagaatttttattatcgataatagatgtatacattcataaaatacacataacataaacacccattacatactatacatgtgatataaaccctgaccatatcccataaaaatggagtttaccatggttccctggtttggaaaatttgtactctctggatatgtaaaaacgaaaataagcttttcaatagtgtttttataattcacaattctcaaatagtaagttagaaaacttatcacaaagactgaactttcagttctccaacacctgcccggtggttgcattccaaatctcacgctacttctctgattgttccatcaacttaacaaaagagcatagcctgattttactccagtaggaccataagaaatgaatgcacccagagtgctgtgatcattatgatggtttcattgagctgtaatccatgtacttggatactacttctatttattttttaaaaatgtgtttgtgtcactttgccaaaggattggagtattacactaatgtcattttggcattcactattacctagggcaacttttgttttaccgtctctttttcaagtcataattttatacttatccatttatttatgattaatcattttacgtgaaaaaaataattcttttttcccactgcagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggtaattttcaggcacttttacactgcatcaatttactttgtgcataatggggaaaagccattttcagtgagttaaactatccacaagattggctttctatgttctcacaatgttagcatgagaaatgttaaggtaattttaaactctaggcaaggaaaagactctcaaggaacgctgcctttgtgtagtgatttccctcattaggatgaaaggcaatcaggctttgatgaaagtatcatcaagaaaatcagaattctctgctctcttatgataatttttgtcctcccagttcccccggacccaaccaaggacttgtccacataatcaaatgttcatcttgtactgttttacttttcactgggacaaaagtatattttgtctgtggcttcagatttaggcacaagcataagagcaaataaatatgataattaaagtttgaaaaaccacattccttgcttttactcctgtctgaccaagcttagtatacgtgacaaggacaccttccctatcacggcaagcatccacaaaagtctctaatgctatcaattctaggattttcaaatcagttcagagaaactgaaatcaacatgtcccatagttctttgaccagtgggttctagttttgacttaaaaattcacaaagattttgtgatagctgacttaagtttaaatttttttcaaatcataagaatgaaggggaaaatatcttcgaatttagcatgcttatttgccaaaatatccccttcccttccagccatacccatctcttcttcatttatctagaagaagccgagaatctgctctatctagcaacctctcccaacaggctagatcacttggtagaaatcggaaggagagaacttgatttaatgttggcatattgctgtctttatgcttggcctgatttgagcacaagggacttgatgggagataagattaagtccagctcctttatacccttcagaaaacaatgaatgcaaatgaattcataaacattgctaataggcttccaaactcatgaaagttaaaagttagcagagaccttggaggcaaatttgagcaatgtcctcatttgcaaagatgagaaaaaagcattctagagtggctcaaccactcatcctaggtcatatccccagctgtggatacaatcattgcaagcaaatggtgcagaccacgtgcactaattgtcactgctctcctttgctgtctgtagggatgctttttcatgctccttgttcaagttattaacctttctttccctgctgtcctaaagagagcaaagtaatcaagattctctccaaatactaaatcagcgtaacttgttcattatcacagctgattaagtgtcaaagacaactgtgtctgaaaagaatatatatctttttttagtgaggaaaagaatgaaacagacactcccttggaagaggaaggggatagcctgtagacttgccctaacaatgacatgcggcacacaccatccctctgatactgcttttgcagctgttctggtccttaaatccacaacatgtgattagccatgcctggaagccttcaacatttgcaaatattgcctaaacactttctgaataaagtttatactggagctccaagccaatgacacacacttaaaagaagcaggtggtttaagttttcatcttttctttccttttcattccatttcctccctccctcttacagacctgcatcagccccccctgactgtgggttaagtcattttattagcaagtcaggctctaatcccagcagctgtattgctttagttgtgcaattaacacagtataatctgcaggaaatcaactgctccctattcaagtgtttcaagtaaattaactgatcaaatgttgcagcttttccctgtgctcctggattttggccatggctttgattactgattattgtaattcccacaggtggatttttcgtttgaagaaaatatcttttcttgtgtttatgtattcatgggcgtgtgtgtgtgagcgtgtgtgtatgtatgtgtgtgtgttctgcaactgtaaatttgaagtgggcgtgggtgtttcctgcccttaaagtaattaaattttttgccaaggaattacatcaatgaaacctgagactgaaatatgtatccggtgtttcatgtgttctagtacttttatcgccagattaatcattatcttgggcaaacacgacttgactttttttttccccattgctaagttgtgtattacttaaaatccatttttcgtatgttaccaagctagcaaccctagaaaacaactggcagctgattttctctattatcgaaaatgttcggctgccttgggaggtgcagccttccttcctgctgtagaccttgccacttcgtgcagtgaattgcttctgaggaaagcagttattcaaatgcgatctgatgaatgtcaccttttgtaatttttgttttgtgtcaaatgtatgtttcaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacatgtaagtaacaaactcaactctgcgacctgccgaacatgcctttcccttttctcctcatcccactcctctcctttaccccgtttccttccaccctgcgtatccacaaggctttcttcatgaaaggataacttaagagcagaccacggaacaggcagagccgctgagcctgaaagaaagcgccttatctgggtggtttgaggaggaatcaaatttccagcatttacaagtagctaaatagaaaggaagagatgcacatagagtgaatgggggcaagttttacaagagtttcctttcgttgtcttaaataatattcgtgtgtctgatctaataatgatgatgatcaaatagtatgcttttcatagctgcacagtggggacctctggtctggttatagaaacatggatttattttccaggcgaataccgtagcagctttgctgcagacgtgcaattagaattcctgcagaaggcagcttgagtggcttgcccaagagggcttctcaggtcacagctttaaaataacctgatttttttttttttaaagaggcaggagtcttggagatggggggtgggaaggcacaagggagagggctgatggcgtggagggatgagacagaacaaagagctgtcgtgtgcccacaattctcaccagccaaaggtggaaaaatctagatgctttggcagcaaagaacatgattttgttgttcactcagttgacaccatttcttcctaagctttgccatcaatatccagtcttccacacagagcagtggagttggctctgtgtctgctgaaagcctgaccattagggagacagggaacagaaaattggtatctgtttcctatattgtgaaacctccaaaattggttcttaatctatttgtacttaaatatcatctcttttcatccacactggttattagccaagattccaggcagaaagaaccttacgaaaataggtaagtaactatgcaggctctctagttgccggtcactatacatccctagagaagtttttataaaatgttctcttttttttgagancagagtagntctntgctctgtaacccaggctggagtgcagtggtgcaatcttggctcactgcaacctccngcctcctgggttcaaacaattctcccacctcaggcttctgaggagctgggactacaggcacacgccaccacacctggctaattttttgtatttttagtagagacgcagttccaccatgttggccaggctggtctcaaactcccctgacctcaagtgatccacccacctcggcctcccaaagtgctgggattacaggcatgagccaccgcacccagccttataaaatatttttatttgtaccttaatgtaactgattgacttatgactcctggtcagtggtacacagatcatctctatgatatcatgtgacttagaccagaaagaaggaggccagagctgactcaggacaagaactaacaatatgaagccagggtgggttacctactgagcatgcccaggaactcagaggatggaagtgttttaatgcataaaatatcatcgacaaatcatgaaggttgccccagcacctgggaatatagctgggataagccattatgttttggagtcaactccatgggtggatatttaagcttctgaagatcttcccctatatacaactctgcgagtaaattcatgaatgaagcccatgtgtgacaagtggctctccattatagctcacttacaaatttagtagccaactgattcaatgaaaggaaaaagtcctgcgggctttttcaatacccctgaacccccctgttcccatttctgttgaatcagaaatcactttacctatctttgttgcattagcagaaacccagtctaaggtgacttcctataactgtaaactttacagatgttccctcaagctggaggagaaggggttgacaaaacagagtgttttgtggctccttaaaagtcagcctgcctttgaagctttgaggcaaggtcctaagcctgcaggaaaatcagcctcaggtcaagagtttataagagctcagttgcatggaatcagtactgcatgaggggaggagcctgcagagttctcagggtctcagcaatagctttttgaaaaacatctctgtgctggccaggcgcggtggctcacgcctgtaatctcagcactttgggaggccgaggcgggcggatcacgaggtcaagagatcaagaccatcttggctaacactgtgaaacactgtctctactaaaaatacaaaaaaaaaataaaaattagccaggcgtggtggtgggcacctgtagtcctagctactcgggaggctgaggcaggagaatggcatgaacccgggaggcggagcttgcagtgagccgagatcgcaccactgcactccagcctcggcgacagagcaagactctgtcttaaaaaaaaaaacaaagaaaagaaaagaaaaacatctctgattccagtaattaaaaattctatttcattccacgaatatttatcagtgccacatgtgacactatgcagcccagcagggatatagataagcgtgaggaagacacagttgctaacatttaaggacagataaactaaggcaggggttggcacactggtacccacagtccaaacctagcttgccaccagtttttgttaacaaaattttattgacacacagccatgctcattcatttatgtattgtctgtggctgctttcacaatacaacagccaagtcgagtagttgtgtcagataccatacagcctggaaatactatctcatcctcgataaagtaactttgccccaacctctgctctaggggcaggatgggcaagtgtcccaatggcaatatcaccaatagggccagaagtgacaagcacagagcagacgttcgcagggctgtggagcggggagggagaagccttcatatctttgaaggaaaccaggaaaacttcatggaccaaggcttcaaagtgggcctcaaaagatgggtaaaatttctgcagataattgtttagagattgggtttcaggaagagaatatggcaaggacacgtggtcactgtataagggaggcaatctaagatgtgtcctagaaactggagaatgggctacaaagaaagcagcactaaggaacaatgctgcagagggaaactgttgcagaatattgagggtgtcagtgagtttgtatgtaactgcaagcagagagtcactggaggttgggtagtaacaaaataggaggtggctcagacatttccacatgcaaatagattcagtagttcctttttagttcaaatgaaccttctattgcccttattagtgattctataaagtaaaatctacacagtgcagagggtggccttagaggctaacgagcctggtttcctgcctcagctgccctcactgagtgtaggggtgctttctttaatctctggaaacctccactgtctcatctgtaaaatggagataatactaacaccttgatgtgatgtcatgaagagaaattaagagaggcagtgtaagtaaagtccccacatagagcctgggacatacaagccacttcataagtgtcaattcttattgaacctttttattaagaaactaacaatattctatcattctggacctacaaaagggcaatttcatgtggctcaacttaaggtttaggggaagcagtgagagaaatgacaacttgatgcttgtccattgtgacatgacagacctcttgacaagctaagactcccattgtgatgagcctctcacacctggccattccaatggaacagacagggtaaggaccaatctggactgtgttatcttttccaggtgcaagtatgtgctatgggtaagtgccagtttggagaactcccttagccacaggaaatgaaaattcatgtgattgtttgaaggattcagcttctctttgctgctaatccttgggttttgtgcacctagaatgtggtctcctgcaggccctgaaagccttgaattcctggcatctttgctgtgaaggtctccctggctgctgctggaggaaggggctggaaggagtgagtgtgtgcacaggttcagagttcagtcttcagacaaaaggagtgagataaattgaagacaagctgccgatggtagtgcatggaactgctcaatgaccagcttccttagcgaaaacattagcaacacattcaggcaaagggatgcgagaagttaagtactttgcagaaatatttgacaggccctgcaaacactgagcaagaaaccataggttctccccaattgcagggatgcaagtaacgtgaacactttcctttcggtcatcttccttggtggtcaggcatcatctggatcactttcatctggcatcgggttataactacctgaccctctcagactggggtgaatgtatcatctttccaaggtgtttgccgttcccaacaaagagaggaagccagttcgctattggcctgttagctttacaaacggatggtagagcttatgcttaccaaggaagagtgaaaggggattatcgaccacttgttgacagggaaaatagtttaatcaaactgtaactcagctactcatggccactgagaaatctgagaaagcctctgtcataataacacacataataatcctagtattagaaagccctgcgctctggctaagactctactatacttttcagtaacttatttccccagaatctccatagggatgcaattccttcacccctgctttaagttacttctctctcctcgcctcagtgatgtcatcatatacacctgtggacaaaagccgtgacagggaaggagatgccatttacgtccctggtgattctataggaaactaagggacctccttatcacccttctatgaactatgcccctgtcagctttaaaaatttgttgttgttattccaatttttttttttttgagatggagtttcactcttgttgcccaggctggagtgcaatggcacaatctcggctcaccacaacctctgcctcccaggttcaaaccattctcctgcctcagcctcctgagtagctggaattacaggcatgcgccaccacgctcggctaattttgtatttttagtggaaacgggttttctccatgttgttcaggctggtcttgaactcctgacctcaggtgatccgcccgcctcaggctcccaaagtgctgggattacaggcatgagccagcacacctgacctgttattccaatttaacagttctttcttcccatacctgtaaatgtgtgtgactgtgtktgtgtgyrtgtacactctgtacactcacacacacacaaatacacaagttcaagtgaaatctaaatgcttggtaaaacagtccatgtgcactaatttgcaagagttgttgtgagggtagagcttttgaataaacataggttgtcaaaggaaaaactccctctgtgtaagccacaggacaaaggttttgaaacacctttgttatctaaagctggaaagaaatgtcttgccttaaaagaatttgcacattcgtacctctttccacaaatacgtgaaaggacgtgcttttgaagataagaaaagtttaaattctacaaaaaaaaaaaatctgatttgggcagaactcattngncntcccttttctctgtttctaccttgttcttctctgggtggatcatttactacttatactgtcagtgttggtgttgcttgtttacttagatccctgaagtcgagttgcacaactccagggggcattcagataaaatatcatgtgaatgatgccctggagttttgcaggtagctttgtcctgaagacagggacaaaaatgtttcatctctttacctcccagtgcctggtggacatgccttcggaccaagtagttgcacaattcattgttgcttagcaaatgaacaaatatgttcacctcactaaatagctgacatgaaaacattttaaaaatagtatcaagatatttaaacagtcgattttatgaatttaaaagacacctagagatactacaattccgtagttttttagattaaaaaacaaagacccaaagtctatattttttaaaggaaggcccagatggttttgtgaaggtcatgtgagtatttagggacaaaactagagctgaaactcaattctcttggccccaggtgatcttctcactccaccagacttactcagttcacatcacagtcacaattcagattagagctatgaacaattctatccatttgcacaattctaactggtgtttctaacttcattaaaagactctgaattatttttcttatatacctctaatcaagatcatttggtattatcctgcatatgttcaaatgttacctatctacagatatttgaacttaggtggggaatatctccacaaagtccattaagtaagttcagttttagtgaaaactgagatggtgcagcttgagagattaagtgtagaatttccaatgtaatgctttgaatgtgtaccttaaatctgtatcactggcttattctgggaattgaagtcttatttcatttctcagagaatgatggttctgctaccagtaatctttaagggttagatcattcgggttttttgtttgtttgagactaaataaatgaagaaaacacatgttagatacaaaacactagaaatatattaattttcactggagcgacaccaaaggccatcgacattaaaaatgaactcctaagttctttgcaattccccaggtatagatttaatatacaacacatgcatctcttgaaactctttctttgctagtaagaattattctcctgaaatacccacctgtcaaaaagaaaggtaacattattgatttttagaattcttatttctgtcgtgtcagtaagcaataccggaaagaaaatcaaacactcaggagaattggcatgatggtgaaggttgagcttacaagtacagtggactcaagtatccatgatccagcgcactgagcaataaatccaaatgagcagtgaccacaggaaaacaatatgcagggaggcctcgctgggaaaagctaaacttttatatatgggaatagtctatggaggattacagggatgttttcttgggggtataaggtctggagtgtgcagtactgggtgaagcccttatctaacaggcaacagaaaggtcttcccaggttaggcacacgtgactctacctccaacacagaatttttttttttaagaaagcaacagaaatttgcaaatgatagtctggtcttttgtcctctcaattttaaagcaaataaccagtattgtgttatctaccttttcatggatgcatccagtgtgcctagaagggccagactttattctgtatttgcaacaaaagtagacccagcaactgatgggaagatatctgattgggaagcagaagcagctggtattttaaatcaggatgaaagctaagattttaggactcacttttgataggaagaaaggatatatcaattttccttttaatgagtgggatttttgaggtactttgtggggcctctggttcaagactgtggccagtgtggtgttgtaggaggggcactgatggagagctatcccggtgcattatttctgagccacctctgtgcactttacttcctcatttgtaacatgggactaatgtgccctgctgagtcctcagagttgctgcaacaatcaaatgagctattaagggataagctcttttccagctacctatgagaatgggtatgatatggtcccagaatttgctctctagagccacagaaatctcttaacccctacaagaactctttaaagttgttatccccattatatagatgaggaaactgagacttagacaaaaagttgtccaagatcacataatattaaggaacagagctgggatgaatatttgagtctaattccaaaacattctggaataactcaatatgtggttttccatttctcccaaaaacaggtacctgcttttttcagtggcttgtgttccagctgacagctccagggcctgtttgaataattcgaagacaatccttagttaggaaagcaagctttaattatcactggggaacagaaggccgcatcttcgaggaatttggcagacctcagcagggggcaaccacaggcctttggcaaaagatcacttttcaacaacattgtcaattccagtgacccccgaccttccacctgcaggtccctgaacagctgctgttctgtgggaagcagtggcagtctgtcttcctttaaaaggcacatgcacactctgtccctgctgcctgctgagatcccacctgggacctcatccccagagctgggggtcatctcccatatcaagaaattaagaaaaataagggggggcaggaaaggacagctttgacaacagtccctgaactttcccttttaatataagccagatttaacgtatgtcattctgtaaatccgggagtccaatttgaggcttgtaatttgctgcaagcttccctgttcctccaagtggggtggagctatgccaagcacatcaaggtaactggtggaagatataatttccccactgtgagcctgcatttcagttccctattgtaatttttatttgtgttgaggttttgtggttttaaaaaagtcaaccagatttatttttaaattaacccagcccaacatcaaaggcaataagtagaggatgtttaggtattataaagaaaccctgtgtaatctgttatagctgtattctttctcagggcatgtaatggtaaatggttaggggcctttcacaaccaactttctatatttctctgacctcggactaccctcatgggcaaaaaaccctttttgaggggatttagtagcccctctnctcctcctcctcaacctcttaatctaatcctgtttgtaacgcaacatgctgcatgaagaatacgaaacatgggcttaagtccctccccacttcccttatgactgtggtttacttttagatatgaagaactctttcaggccaaaaaaaaaaaaagggggggaccatttggttaacgaaccattttctttggtaggcaggagaaagtttatattgaaagtttatcttaaggatgacaggtcatacctgaagggtttgttttggaatactgtggattttttctaacccaaataattacaagagagttccttgtttattggctcatggaggaaattcaagcgcctctgttctaggcattttaagtgctctgtatatatggtggttgttcctcaaaacagctttgggtttgttttttgttttttgttgttagtggtggttttttgagatagagtctcgctctgttacccaggctggagtgcagtggcgcaatctcggctcactgcaccctnccacctctctggttcaaaagattctcctgcctcagcctcctgagtagctgggattacaggcgcccgccaccatgcccagctaatttttgtatttttagtagagacggggtttccccatgttggccaggctggtctcgaactcctgacctcaggtgattcacccgcctgggccttccaaaatgctgggattacaggcgtgagccaccatggctggcccaaaacagctttttaagaaaagtgctattaaccccatttacagatgagcacatttgagccacaccctcttttccacactctaaatcttgtctctttctttaaacatgagttacttatacttctgagcataactgaggcacttttagagacagtgtcttctaagctcaatgtgatattatttgtgctgctgtgctgctactgggtaaccagcacccatcctggtcaccagggtaactttgtcaaccaagaaggccaaggatcccnaaaccagcattttctactatcaaaagagaggttctgcaaatccactggcaggagagaaaatataatagcaggtggcatttatatgacccagtgtgcatggcagtgtcccagggtatcaccgtgaatctcagaaactccaggctttccccatgggaaatccacaccaccacagatccagtggaggactcggtcaagactcctgaaatcaaagaactcacagtgactgattctttccctagttttataatataaataatggcatggggtcacattcagccgtcattatccacatcatttcactgatgggatcctcctcagacagagattgggaatcagatttctcggtcacataaactgttgctcattctgtgaggctgcctatttgtaaagttgtggttcttattaaaagcaatctcagacgtagcaagcacccctcacttcccttctcattcattttgttaaagcaaatgggctttggaattcaggcctgtttctaccacttactaatgttgttaatttggaggagttcctcaactttgccaaggcttgattttctctgctgtaaagagggaataataaacctattttacagagcagctgagacaattaggtgagttaatgtatataaaatggtttgcataatacccaacacatattaaactctcactcggtttttaatattaaccntnctnatgtngcttaataacattgaagaagaagattcaagtagattatagtctgttaaagagttcaaatataaataaataattctcagggtgagaattgccatagcatagatatgttacgtacccatggcagagcgtgaggtggcagcatctaatggttgagggagttgggtgagacatcaagagaaggtgacatatttttttgagtacccagtggaaggcatgggataccatgtggatctctgcagtagattaaatatagacttgaactaacctatcctggaacaataggacaatatccttgtggcttacagaaattattccctgcacctatattgatttgtttattaaacgaatagctttattggtaaacatgtatattgcggaagtagacttggttatcattcccacaagtccagttaaagtaatggcatctatataaaaaactcataaaaactagatatgtaagtaatcaataaaatactcttctcaagtattcaggagaaaaaatgtgttgaaatgatgattcatcattccacataacgtatttgtgactacatttaatagcctcattagcaataaaatttttatgagttaacatcatatgaggatattcccttgtaccttaccgagactttatctgtagatttgtaacataaccataatcatcttggtatgtttcttacacattttattcagtgaacccaaatgaacttctaattacatgttcagctgccagtcatggttttatatgtttgaatatatataccttcagaggatatttgctctttggggtggtgaagacttcatcttcttataaatgcaaacagaagatagttggaagaggaaaatgttttagcagtgtctcaattatctctccttaatgattatttcacaacctcgagatattttcctaaaagactaagtaagaaatatatagtaagattcctttctggatattttcagaactcctagttataactatgcaccaaatatggataaacactggattatgcagtacacaggaccaatgctgcccatccacatggaatttacaaacattctacagcgcaaaaggctccagactttgatgtcagtggatgattctgtggagagggtaagcacatgaacctacctcagtgatagtttttggcccagcttcctttgtgtagacttattcttgccaatcctgtttggttttttccccttcattttccagcatcattttgagagagaaagaaagagagagagtatgtgtttagtggcttaatcatccctcccttatcttgtcctcattccatctacctctccagggttggtttcttatggagccagtaaaaaagaggagagaaaaatcaaatcagcgtagatcaggggccacatcctcaaaggcaataaagaattgatggagcttgtgctgaacttgaactttaagttaagggccccatctaaaggaacagcaattactcagctccagctaaattttgccatgtagaaatgtggatcaagtatcagcaggtcttctgacttttttaaagaagccagaaacacaaaaaattttatttgaaattttctgaactttgaaacatagtataagccaaacaagacgtgcctcaggctggatttaactggatcaggctcagaagcagcctgtttttaacccttggtaattagatatgtgatgataattttaacaatggattttcaaagtacaacctataaagtttgatggtagaggttgttgtgcggggtgtttttgtttttgttctaccaaacaagcaaacaaaaagcctaaaagtagaatgtgctagattccaaaaagttacatttcacctttaccattggacctttccctcccagactgtaagcaaatagaaaatgtggataatgttattaaagcaactcttgccttttaaaaataacaggaaaaagatttgggggcaatcgtggcaacactattgagcatcatcttataccagcacaattgattctgacttgttcctttgctgtatttcagctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatgtacgtatttctctgtttgcaacattcaactgtcgtacctcaagtgtgtctaagataattcaattaccagtctcagtatctggtttcctttcatccaaaacaaaaaaggatgtgtgtaggctggttaatttcgaagatgaaaaccttttcctccctgccacatcttaaattagctcaagtatactacttaaagagaaaggaaaaataagtgtatcaatgactaattctctcaaattgactggaatctatgtctttttggtctgtgtgcacagacaggatgtgatcttctgggatatcacccttctttgaatcagagatacgctgtcatttaaaaaaaaaacctgacaccatccttttagtgtttaacttttaaaaattattccgaaagaaatgtttttaaaagataaattttgaaaagctggcttttcttttaaaggaaaaagagctaaaggactaggctgctatttctgtcactgtaggcaggtcactgcttctctttgcatctctattttcccatcatgaaatggccttgcctattttcccatcataaaatggccttgtcaatcatctcaggatgttttgaataaaatgggattgcatccatgaaagaattatggaaagactaaaagaaaaagtggaagtagaatccagaagctggaatggcccttgaaaagcatctagcctggacccctgatgtaacagtgaagctaggcagacagcgtcagtgcccctctcagatccctgattctggaagtggtggcagtggggcccagagcccagatgttctgaatctcccccgagtaccacatgtgctgctgcatcatactacatcctggagagagggcaattgaagtaagaaaggtttctttgaagaatgttattgtgcttcctaagattattagaaacaccctgagaattgtcagatctatatctagaaggctttatgttttaaggactagatagcatagattgaattcaactgtaaaaactgtacatccttttttaaaatattgattttaaagctcttgttcaacggaaaagttatggactattgggttttaagcaaaagtatgcttgctgcaaaaaccatgtatcaggctgcatcttgcctggtgatgtggtcagaatacaggggtgcaggcatctctccagcctgaccctggcaagagtcagttaatcttgctcagtgccattgctgtgatcacacacccacccttgccacacaactacccatgcctaggagaccagatgagagggtgagaagagttgaaggccaatgagtcactgctgtagaaaaagcagccctaagtgccaccttcccctggcattggatctcagccatcaccgtgtgcccctttacagagtcccacagatcgttctcaacattgacttggcccccacgatcctggatattgctgggctcgacacacctcctgatgtggacggcaagtctgtcctcaaacttctggacccagaaaagccaggtaacaggtgtgtcattgttcctcctctcagccagccccaaatacactgagctccagctggtgcccagagccagccagcagctgaagacatggaggcagaatatgccttgcccacaaggatcaccccaagctgagcatttctcagctgcttgtgaatagcatattgatggagatgcactcatggtctgtgggaagtgagaggtgtttctttaaataagctgttagcacagatccatttggaaaaacgtccagatgccaaaagtaaatattatcattttgctttcaggtttcgaacaaacaagaaggccaaaatttggcgtgatacattcctagtggaaagagggtaattattggttcctggggtgcttctgggaaccagtcctagtgggcagctttccctgctgagtattttttttctccttatttttgtttactaagcatgcagatttcgtaaacctagtcacaagattgaatggtttgctgcttattctgtagtggtcaatagagtaataattgctggatcagaattgtaaagaataaccctcaagttggttaattggtacaaaaacacagttagatagaagttatagaatttgatagtatagttgggacattatcgttaacaataatttatgtatatcttaaaatagctagaagtgaagaattgcaaagttcccaacacaaggaaaagataaatgagatgatgaatatcccaattatcttgatttgatcattacacattgtagactggtatccatatatcacacgtacccccaaaatatgtataattgtgatatatcaatttttaaaataccaaaaaagcaagagaatgacgactccacatcccccaaaaagaataaattctcataagcttggaccaaagcctttatcatgggtgtagatttactgttgcatttctcagtgctggtttctaatcagaccagtggattgagtttctctaccatcctccccacgttcttctctaagctgcctccaagcctcacccggcacccttcttcctacttcctacttcttttccttgtgtgcctttcctagttttaaatagataaatgtatgccattgtaattatttccattgtcacttctgggtttccccttttggttcattaatacccattgccttgtttttctctgtacataaattaggagagagaaaatatttgtataatttttttaacaaaaggaactttgagcatgtaaaatgaaacatgtatgcccaaattttgaaattaatgcttttgggaagaacgaatcttttcctgacctctcatcttcatcctacccagtttgtcattttcataaaggacccatcaaatgttgaactcctgtagacagagctttaacatctatttcttgctgtttaaagaatgtggagtcatgtgacagggtaaaaaaaaaaagggggcaggactcagggaccgtaattcagatcacttctcatgtacgaagcttttccctttttgtcgaagcaaatttctacgtaagaaggaagaatccagcaagaatatccaacagtcaaatcacttgcccaaatatgaacgggtcaaagaactatgccagcaggccaggtaccagacagcctgtgaacaaccggggcaggtgagtgacgcaggctttctttaccaccactcatgtgcttctccatctctaatttagaaaattgtccacatataaaagaatgtacatttgtgtataaataagcttttcctagtggccttgagggcaagctcactgagacacctctccgcggacagaattacgtaactggttcaggctgggcctccccattactacttgggctccctccagttaaaaaagatgatgatctcagagaaagttctatgccaaaagacactggtttcctctgaggagaagattcctgttatagtccctgttaactagtcactgaagagttgccaaaaggctacttagtcaaagcacaggtacgtgctgagcctcttggcagtgaaccaccccaagagacatgatagggccttcaccctaggctaaagtcagaatgtcatcttacccccagtagaggacagagcctgtgaccaagcttgaggaatgagaagagaaaccatattctgtttgtttattgttcctacttctgctcacaaagattctggcatcaaatatttcattagaatagatcctcttcgttagtagaaatattactatagaccccagagctacccagaataccagttattatcagtaagaataaaagaaatactgtgtgatgaattaacattgcttttaaagaaagtgagtacgtatgaatttaaaccagtttaaaaccattgattttaaatgcccttgattgaaatgtatgctagctaaaagaaaatgctgtgtcatgacaagaggaactgaactttggcccaaatcattgcagctgagaacaaaatcagaggaaagtgaaaaatactaacacatagtgagcatttgtcttacatcaggcacagtacgcaggattttgtagcatttactcaatttaatcctcacaactgtagagtgaggtgggcattggcatctccattttacaaatgggcagctgggattcaaacaggagttgtctgattcaataactcaggccacttgctgccttccaaggtaagttacaataaccaggtgaagagaagttcaaatctgtgagtcttttttaacttaactgacctctagatatccacacaattcaccaacaccagttcaagatgtcaggctcatggaatgagtaggtaacaaagttattattaaaatggcctcactcattatacgcttattatatggtatctagcttgttgaatagacattcctaataaacaacttgatccttataccctgcatttcctcatgctttcttgtacacaggatccctttgaaatagaagaggatagggagggagagctgttgaaggaagggctaaaactaagccttcactacattctagtacatcttaattttcaagtgtttagtggagaaaagctgagacctattcattatattttaatttgaagtcttcaaatctttcttatgaaacctccaaatattattatgaataaaacctcagaattgttttgtagctctaagatgatttttatgagctagcctcaatagactaatttacttttattcaggagttgcaaatgttcagtgttaaatatatctcatgcaaattggtgatcttgttactcttttagctctaagaggtgaacattatagccttttgggaataaggtacactgcctacatttcagtgtgtaattttacaaacctctccatatggcttgccctaaaattttaatatatgtcctaaagggcaaatgtagcataaaccagattatggtactttggcacaagcttttcactcacgagctgaatgctaactaagttacaaacttaattttgctttttcatattttttgaacttgttttggccccatgaaatgctttcatatctggaattttcttccactgtttcatttcgctgtgaatcagtctgaatttagatccattatgtggatatatgagaacgtcagcaatggtctcttttagaaaggcctgaattcgtggaacaaagaattaggctatgccctgatggtgatttctttctatagaatttctttatattgggcctgagtgagctttagaagtgaagacctggagagtatttcagattgtctctagcttcagtgtatccacagcactagtgaattgttactctaatcccgaaccagcaggatcagcatccctgagagtttgtcagaaatgcaaattctctggctattgcagaccttctgaatcagaacccctaggggtgaagcccagcaatctgtgtgttaacaagtcctccaggtgactctgatgctccctaaagtttgagaagcactattctaacccacgattgtgtttactggtggccctcaaaccatagcttaggaatctaagaacttcaagaaaattttgagccttaatctttaaagcagttattgaatctgtgggtcaaacctgatagctgtgttgtgtgttgttgttttgttttctttgggacagggttttactctgtcacccaggctggagtgcagtggcgtgatcatggcccactgcagcctcgccctcctgggctcaggttatcctcctacctcagcctcctgagtagctaggactacaggcacacaccaccatgctcgactaatttttgtgcttttttagagatggggttttgccatgttgcccaggctgatctggaactccaggactcaagtgatccacccaccttgacctcccaaagtgctgggattacaggagcgagcctccatgcccaggcagctctgttgtgttctatcgactttttatatcttggccttttgctctttctttctggctactttgaagattatctgtttttggcgacagtatccctgactttaaaaaaggaagaagaaaattcagaataatgacactgaattgttcaggttcgaggtggcagcggaggctagaactgacctgcttggaatctgctctctctcgatgtccctcctgacatgcgccctgcttccgttcctcttaacaaggtgaatggccttcattccaaggcaacacagtcaggttttgacactccatggggaacaaagggaaaatcagcatgactagccccattctcttcactcttaatcccagagatagtgaatgcccccctcctaccacatctttgtgccaggtcacctaaaggttgtttggtggagtcaatgtgggtgcatgaggtaagtcaacagagaaaagagatccaaaggttggggttagaatattggccgccaccactttctagttgtgtcttctcaaataggtcacttactttctcctgagtctcaggttttctatctctaaaatagagaaaattaacctcacccttgtgaggattaagtgatattatacatgtaatgtactaaagtgagactgagattttctctagtgtgcgaatattgggtgttattattattccaagccatcttacctgctgttttcattcctatgaagccaattagaattaaaatgggctgaggccgggcacggtggctgatgcctataatcccaacactttgggagcccgaggcgggcagatcatctgaggtcaggagtttcagaccagcctggccgacatagtcatagtgaaaccccatctctactaaaaatacaaaattagccaggcgtggtggtgggcacctgtaattccagctacttgggaggctgagaccggggaatcacttgaacccaggaggcagaggttgcagtgagtcaagattttaccattgcactccagcctgggcaaaaagggcgaaactccatctcaaaataaataaataaatataaaaagaataaaaatgggctggaatcccagagacttggcatcacttcttgactatgtgaacacaacaaccagcggggactaattaagacaacatggacatatgtgtttgcattacttccacgttcctgaattaatatgagatggagtgtgaattcccaccactctctcagctgggcgttacacccccggacacgtttatgtacagacaccntncncccatccccctacaccatcacacacatgcacatgtgcatactgaggggcaaatctcgacctctttcttaaagcatgtttgttccacagagaacaaagagcagtgatgctcaatgctggcggcacattaaactcacctggggccgagcacggcagcttatggcttactcccataatcccagcactttgggaggctgaggcaggagttctaaatcccctaagcccaggagttctagaccagtctaggcaacctagggagacgccgtctccacgcacaaacaaaatagccaggcgtggtggtgtgtgcctgcagtaccagctactcaggaggctgaggtgagggaatcgcttgagcctaggaagtcgaggctgcagtgagccgtgatcgtgccactgcaccccagcctgggcgactgagtgagaccctgtctcagaaaaacaaaactaaaataacagaaaataaaaaataaactcacctgggtggcacttgaaaaatgctgatgcaccccccagaccaaccaggttaaaaatgtctggaagtgaggccaaggaatctgtattttttaacgaggttaagaatcacaggcctagaaccagagaatatcaaagtttgaaggaatcttagaaatcttctaagttgaatggtatcatttttctgataaggaaatttaggtccagaaaagttaagctacaaacccaaagccaaaacctgcatctcttcacttcacgttgagtactttcttccctgtaacatgctgccactgcaaaattgcaagacagattttccctttgaaactatgaatggcaatcaccactcacggtggttctcaaccctgactgcacgttagaatcatatgggcagctttagagatgcttatgtttaagtcccagcccaggcaagttaaatcagaacctctgggntatgagacccaggtaccagtgttttttccaagctcccctgatgattcctacgtgcagacaagcttgagatccacaaatgtcaagtgagcattaatgggttggtttttcttcttcttctaggcataggtattgacgtcttaaataggagctacataaaagagaaattccctgggcatccaattttgaaatacactttacatattatctggcatttaagtggaaaaaagcagcctgctttgttttgatagggcaaatatcacatccttttgatgagttgttgaattccagcatctttacaatttagtttgcctttctactattggatcaatataaaatcaaacatttgtttaaaaatctgtgaggacccctgcatcaagcaagctgatgctattataacggaaatagaatgtagtttgttgagtggaaactggtttagctccaggatggatctttgttcctatacaaaacttatctctctggccgtatatccttctgaccctttgtgaccagcagcagagcatgaataataagacatttaccatggagatcctcctagaattgttagttttccagaagcagacaaacctgtttcccaaaactcactgaactctggtcaaaatggcagcatggctcatagacatcttcccctggctaacctgattccagagggcacatccagaaggattgagctcccagtgccatccttttactgaattctcctctgtgcatgggtccattgtggaccactcagcctttaaaccttgcttccttccctcttcaacccatgctgaagctcatgtatgaacagttgttcatctaattaaatctttgacttctgtgcatttgttctaaacaagtcaaaaaaagacaaacatgagaataggcattttactcataaactgtataatacagccccattctgcttaatttgtactgtgtcttcttttccaccatttcctaacagcccatcctaatcaggtcctcctctatgtttcttaaatgttacatgtgaatcccactttctcacttgcatggaggttgttacttctctcttctcacctaaggctcaggtcctcctctatgtttcttaaatgttacatgtgaatcccactttctcacttgcatggatgttgttacttctctcttctcacctaaggctcacctgaagactcatactgccttcgtaccattctccttttcatcagtatcctgatcaaggtgctttgggattacatcctggatatactgctttcttggcatttgcctatgtgcaagtttcttaacctaactctgcctcagtttcttcatctgtaaaatgggcatcatatagttcttgcctcataggctgtggtaaatgttatatgaattaaatgtatcaagcatctgggacaatgtctaggacatagaaagcactcaacaaatgctggttgtcaatcattggccaagatcagtttaccaatttcattttctaggaattacaataatcatacatcttccaacattccagtgttgacttttacaagggattatctagattaaaatctataacaggtaacatttctctctcttctgcttctccttttctgttttccgtccccctctctttcccatctyacaccatctcaaagaaaacaggccaggagataaatcctcctggcacaagtaacactaattcatatttgtgagagaaaatttgacaatgacttgagctaagtagcagtttggacaaagatgtgaatatggtctttgtatattccccagtgttaagataaatattttaaacacatgtccacatgcaggtaacttttttatgatgttcatgttggcatgaataataatcagtttatcacaaaattactatacagttgtgacatttcagagaacatgatttgacctgcattatggccaaatccatgtcataagacatatggtaaccaagaactagtgtgtgtttatgtataaaattaagctttcactgcagtgcacctttgaaaaagttgtacacaatttttttaatttttctttttatttcaatagttttcgggatacaagtggtttttggttacatagataaattctttagttagatttctgagattttagtgcacccatcacccaagcagtgtatactatacccagtttgtagtcttttatccctcacctgcttcccaaccttcccctccaagtccccaaagtttattatatcattcttatgcctttgcgtcctcatagcttagctcccacttgtaagtgagaaaataaaatatttggttttccattcctgagttacttcacttagaatagtggtctccagctccatccaagttgctgcaaaatacacattattttgttcctttttatgcctgagtagtgttccatggtgtatatataccacattttctttatgcacttgttggttgatgggcatttaggctgggttccatatttttgtaattgctaattgtgctgctataaacatgcctatgcatgtgtccttttcatataatgacttcttttcttttgggtagatacccagtagtaggattgctggatcgaatggcggttccattcttagttctttaaggaaactccatactgttttctgtaatggttgcactaatttacattctcaccagcagtgcaaaagtgttcctttttgccacattcacgccaacatctattgttttgttttgactttttattatagccatgcttgcaggaataaggtggtatctcattgtggttttaatttgcatttccttgatgagtagtgatgttgagtattttttcatgcttgttggctgtttgtgtatcttcttttgagaattgtctattcatttctttaccctacattttgatagaattattggcttttttcttgctgatttggttgagttcctttgtagattctggatattagtcctttgttggatgcatagtttgcaaatattttctcccactctgtgggttgtctgtttactctgctgattatttcttttgctgcgcagaaggtttttagtttaattaggtctcattcatttatgtttgggtttttttatatttgcttttggggtcttagttatgagttctttgcctaagccaatgtctagaagagtttttccaatgttatcttctcaaatttttatagttttgggtcttagatttaagtctttgatccatcttgagttgatttttgtgtaacgtgagagataggaatccagtttcattcttctacatgtggcttgccagttttcccagcaccatttattgaatagggtgtccttaccccaatttatgtttttgttaactttgtccaagatcagttggtggtaagtatttggctttatttctgggttctctattctgttccattctatgtgcctgtttttatgccagtaccatgctgttttggtaattacaggcttgtagtataattagaagtcaggtaatgtgatgcctacagatttggttttttttttttttttgcttaatattgttttggtgtagccaatttttgggttttttttttttgtttcttactcatgaaaatggacacaagtaggcataagtaagaacagagaacaacatccttaaccaatctgagaaatatttgcaattcaaaatgcagaaattataatgattacttagtggatacttcaggaaggaaaagcaaccagaggtcatctaatattgcactaagtattttacatggaaaactgttctatgagatacatattatgcccattttagatatgaagagactgaaactcagatgggaaaataacttgaccaaagtcacacagctagaagaatgacaaacctgagttcaaaccaagatctgggtgactcaaagcttctgtctctctcactaaataataattattttgtacagtttaccaccagaaaacattagcttgcccaggattggataaactttttaaaggccaattatagtactgctctaggttcatatagtacatcttttccttagaacttcaaaacactcaaacaatctattctcatgactatccatgaagccaggaggagcaagtattattttatcggatgtggaatccagaagaacaaagagattctgcaatttgctcaaagccatagagttagcagcaaaaaaaaaaaaataataaaattaaggtctttgaatcccaacccaatactcatctccattaaaaatggctacctcttatcaaatacacattagatcacattctttaagtaataaaccatgtgtgggtgtatgtatgtaataataataataatagcagctgcttttgttgagtgcctgccatgtgctgagttcttaccgtgtgttatcgctaatgctcataactctgcaaaggctaatgtggcatagcttacttgctcagggccacatagccatgtgatagagctggtgttcaaatccaggctttttgagcttgcaaatccagactttttcctttaagccacaccgatgagtaaaaaacaccattccgagtccaagacagaatataggtaatattcactactacgaaatcctatttcagtaaatgacttgtgacagcactctgggttgtagtgaggattaaatgaaaaattcataaagagtgctctagagcagtacctgctatcaagcaagagttaaataaatgatcataatcatggtagtcaagatgatgatgaatgaaattgtttgaaatgcgtttgacatatttctcattagatttgattccaccaaactagctgcacactatttgtatcctcataccaaaattgccagccttctcttcttcatcaggtgttatttatatacaggcagatataatcaatcaaaaacactaacacataattacctaaccaagtgattctgtgctgagataacttctgggaatgactcaggaatatgagacatggcccttgcccttaattccaacttccaccatagttggaaaggctgaaagaaaattataacaacttaagaaattatttaaatagttttatctagcacctcacccataattgctgtgcagaaatatttgtggaatgactgtgtgctaaattattggcacagactgataaatcagacagaaggagaacggaaataatgtagttgcagaaaacaggaaaacaatttgcagaaggaatgaaccatcagtgaagatggagacaatcggatttggcaattaactgatttactgataaacttcaagagcatagataatagaaagacagtgtgacagctgtgtttctgcaagggcacttgttgaacaaagctcatttctgaggctgactccacacatcccattagcaggtgcctcacctgagctcaggctttcatctgattcctgaaactctcctgcaatgcaaaaaacatcccttctcattattttgactatttaaatggcttgcttcatgagtttcagagcaattcttttaaaaattctctttatctgcttccctctataaactctctaagatcaccactttagttgtagctatttcaaggttttattgtgcagtcataaaaattgtcatgatatcgagttctaaaatggctgtggcaatgtgtgataattacatttcattaaaattcctagtatgcttgccagtaggaagattttcaaagcctctagttaattactttatctaacagggtctatgactttttcaaagggtccatggtagaaaaaataattgacatttttgttcatggctcttgcttcatccaagtatgtgtgtagatatatgtatatatgtagtatgtatggataatatgtttgtatgcatgtgtgtagacatatatgcatatatgtatgtatatttgatttcgtatgatacatcatcatagccaaggacagtgccagacatccagtgtggttaaattcaactcttcagaaaggaaacaccttttcccttcatctctatcccataggaaaccaacaaagaatttggctaatgggaaattcaactaggattccaaatagcctaagtcactaaaacttctgcctacacctttgtgttctacaggaatctacttgtaccctcagctcctccagggcaaaaacaaacaaaataggcagaattctttgaatgcattgtgattataaaaaccacaggttttcactatagtcatgtgctttaaaaattagtatttgtactaaagttgatataaattggatccacaaaaagactttagaccattatttttcaagaatatatatatacacacacatatatatgtgtgtatatataatgtgtatatatatacacacatatatgtgtgtgtatatataatgtgtatatatatacacacatatatgtgtgtgtatatatacatatatatgtgtatataaatatatatacacatatatatgtgtgtgtatatatatatatatatatatttttttgagacggagtcttgctctgtcacccaggctggagtgcagtggctcaatctcgggtcactgcaacctctgcctctcaggttcaagccattctcctgcctcagcctcccaaatagctgggactataggcatgcgccgccacctggctaatttttgtttctttgttttttgtttgtttgtttttggaaacagaatcttgctctgtcacccagcccggaatgcagtggcatgatctcagctcacggcaacctccgcctcccaggttcaagtgattctcctgcctcagcctcccaagtagctgggactataggcgtgtgccaccatgcccagctaatttttgtatttttagtagagacggggtttcaccatgttgtccaggctggtcttgaactcctgtcctcaggcaattcacctgcctcagcctcccaaagtgctgaaattacaggcttgagctactgtgcccggccgttttttttttttttttttttctgtatttttagtagagagagggttttgccacactggccaggctggtcttgaacccctgacctcagacaatccagcctccttggcctcccaaagtgctgggattacaggcgtgagccaccacacccggcctcaagaataaaattagccatattttcctgtctgatagaagatggagcacctcttacgcttccacttggctgtggattgtgaattcactagccgattattttgcttctctaggcattaagcagtcaactcttcatttttaaatgctagaggcagagatcatccaggtagatggataagccttaaaccatttggatttaagacagatatacatacagacagacactcaaatgctactgattcccaaactttgcaaagttacgaaaagttatttattttggcaacactttccccagcaataattctatatagcatatagttatatgttaatggagttgtctgtcagtttctgagcccaggctgtagtgcagtagcatgatggcatgatctcagctcactgcagccccgacctcctgggctcaagtgatcttcccacctcagcctccctccaagtagctgggaccacaggcatgtgccagcatgcttagatgtatataccacaggcatgtgccagcatgcttagctatatatatatatatatatatatatatatatatatatatatatatatatatatatatatnantgttnttttnnttttttttggagagacagggtttcaccatgttgcccaggctgttcttgaactcctgggctcaagcaatccacctgccttggcctcctaaagtactgggattgtaggtgtgatccaccacacccagctctgagaacttttttgatcatttcttggcacatcctaaagctaattggatagccatgaatgctataattgggtctgtgagtgccacaaacccaggcctggaaaccactgatctccacattaaatggcagaatcatgaacaggccgcatgcagttttcagctaagtcaaaattctgtcacttatcaactaactgtggagacagcacaaggataactggtttcacttaaacaacgcacatagtcctgaaagcataggtgcactgatagtattcatccatccaactggagtcattttctgacctgcttacatcagtacatttctagacacagcttcctttgcacatgccgcccccaccaattacacgcatccctctcaaagacccatgcatctgagctacttagacttaaatatatccctcctgccttccccatggaatccagctgcaaaactgtccagtaagcagttgctaatgtaaagcagtggcctgaactccaactgcacattagaatcatctggggagcttctgaaagtccctctgtccagccaaatttgagaaccactcatctgacctaacttcctgtgtttaattaagttgacttcacagtttttaagttaaatcatctctaacttagtccttaggctgttcttgtttgtgttgcctttttgtggctttgtaagtaaaatccaccctctctatccgtgggttctacatctgtgggttcaaccaactgcagattgaaagaattgaaaaagaaaagatgatttcgtctgtattgaacctgcataaactttttttcctgtgattattccctgaacaatacagaataactactaattacatagcatttacattgtattagatattacaagtaatgtagagataaagtatacaagagtatgtatgtaggctaaatggaaatactacattttatatcagagacttgagcatttgtggattcgggtatctgcagggcatcctggacccaattctcagtggatgctgagggatgactcgttagtcgcctgtctgtcccttgagctcctgcttctctggatgaagatgctaaacgttcaagacatcctagccaatccacaaaaaaaggttgtaccctgatatggcttgaaacaaccaaattcagtagtaccaagagtatagggggctaaagcaaaatcatagaagaagtcctgtatctctaggatttggggattatatagtagaagccaaaaagcagctctgataattcaacatacattgaagacatacaactcccttaagagaaagcaaaccatggctctgcatcttggttcatcatgaataattgcatatcattttgtacacgagtgtcagttatcagcaaagccatctgggacctttggccaaactttactttgcagtaggacactttgcaaccaagatatcaccccaaatatgtactggtataagagggaggtatgagatccttttaaatgatgcatggaagaacatcttttatttaataattatttatttatttgaatatatttgaaaatatacgtggcacaaaaaaccataattttacagtgcagatagtattgttctgtccacagtttagaaatgcacccatttaaagaagagtttctcactctttaactagatatgaacaaaaacaataaaggataaagaaaagtttcagtagataatggtacacaactgatagacctatatggaaaggaaaaaagacaaaagtgtgataacactatattttaactctgtgacaactgtggccaacttaaaattaaatattcttcctgcctccccaattaattttgtagggagaagggggaaaataaaatgtaaaagaagttattcagtctttaagtaagatgtggaggatcccaggaaatgacccccagggtgaagagctattatttcagccaggttgagattcagtaagtgcaaggacacttagtccagaggcaatgtcatatttacntntnggatgtaagcctgcagcatctgtggcaggcatgttagaaggctcagtctagaaaagtcagtgcaagctccccgtatgtgtctgttgggaagtgaactctgtctcacatagcagcatgcccactctctgccgagtatgcagttgaaactgcagagttccctgatccccttcacaggatgtgcaacaggggtgtggcatgcctgcttggtcaccaccactgctcaaacccctgatgagagggggagcacgcagataggcaggtacaggaaccagggcgagtcttttgggctccagccctgcggtagtatctaggggcgggtgccgacggccccagtgttacaatgctcttttagccttgccgtctgcagacagcttgttaaccagttcaatggaccctctgccttttgacaagggtagagggccaatatgacagctttccgtattccaagctcttgcctagctcttggaagaatcaggtcacacacgggcttgaaggatgaatgcagggttttactgagtgttggaggtggctctcagtgggacggatggggagccagaagcagggatggagtgggaagatgatcttccccagtttggccgctggatggccacactcctctctgacccctagccaagctcctctcagtgttcagacgttcctcttctgtctttctctgccaccttgttccaccattcgtcagcttgtctcctcatctccttgtctgcttccggagcctgagtttcagggtttatatgggcacaggataggtggcatggcaggccaaaaacaacttttggggtgcaaaaacaggaatccctgtccccatttagggctgtagattcccgggcttgagggtgaggcctttgccaggaaactaccttcttctacccagggtttccctgtcttctgtccatatcacaatgttcttagaaggataagaaaagacacaaaagaaagcctgacaagtttgctaatgtctggggtatatgagagttggctcgccccatgatgggctccaattaaattcatctctgtcttcctcatgtgccattcttccctggctcacattagaaattcaggagcggagaacaaagcagccaagtttgtttttccagagcaagaggggtctggtgaaagcagtcctgacagctgcaccgtgtgtcttggtgaactaacggcttttacgtgtttcattcaagactgtttagtctgcgtgctaaggattcatatatcagtttttggctctagtgacattgaggtagtttgatttccaatgatttcgttgtcatctgtatttgcctacagtgaaagaaataactgagagtcgagttagtgcagggtcacttaaaagcttgcctttcttcattcactctccttaatgatattgccagtgcttctaaaaaaaagaaaaaagaaaaaaactaaggcagcagctcttaataaataacacctggagcagaatcggtaaactgctttcacgttggcttttgcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaagtaagccacgcttttgtgaccatctcaatggtggcctaggcctgtgggaataaacaatagagagacgaaagggttgctccttctacattttagatattatcaatgcatcattttcaggctaaaagcacatcattgctctatttaaaataagaaagctaagactaatgtgacattttgctttgtaaacattttcacttaagcatagaatgaaaatatagttcataaaagcaccagatgcaaaacatatgcacacataaaagagtttataaaatggttattccaaaaggtaaaggatatggtttaagtccattttattttatcgtaatgccaacatctcctgacttgtctgcctgaagttgcttttaaaaaatagtaaatacaaggtttcagtgtgtatgcatttaattttaagaggaaaagcataaacacttttttaaggcatatattttaatctctgttttaggacaatatatgtatgttttaattctgtcaaatcattggatctcgttgattggcagggacaaactagttgcattcagtatgaaaaatacttcctagaattttcttaatagctataagaaacctacgattatataaatgtgaaaatccacgggctgacaccctccacgaaagaatgaatctagtaccacctagtggagtaacatggaaaatgactcaattttatggtgatttctttctatactggtttggaaagaagcaatttaagtaaattaaattctatgtcaaagatttggaaatcaaatcatacactagaacaatggaagccctgagaacaggcatttttattgtagactccacaatatgggcttcagggccatgccctgatatttcatccaaaattgttgtgttttccatgtgtatatggacatttgtttccatgtcaacaatttttaacaaattttaaaggaatccgtaagccaaaatactaagaatctttgatttgggagactttttttcttccctaacagaaaaattccaggtctaataactcacacaaagatatcaaatttctgaaaatcaataaggccaggcgcggtgactcacatctgtaatcccatcactttgggaggctgaggcaggcagatcatttgaggtcaggggttccagaccagcctgaccaaactggtgaaacgccatctctactaaaattacaaaaaaaattagctgggcatggtggcacacgcctgtaatgccagctacttctcggaaagctgaggcaggagaattgcttgaacctgagatgcagaggtggcagtgagccgagatcgcaccactgcactccagcctggatgacagagcaagactccgtctcaaaaaaaaaaaaaattaataagggacgaggaccccagcatgctcttttttcagaagctgattagcaacattcagtttagaagtaggagtgccctcttctcttccagaaagttcgaccttgtttcccaggcactgggcataaggcacattgatttttcagtattaggcacaaacacaagtctagggcagctctctcaaactgtatggaatcttgtgtatttgagagcaggagtcggttttcaccctttctgcaaggatggaactcgtaagcactcttattgacacccctactgtcacggaggttgctccctgatctggaaactgcaggattcagctgagaggtgtctcagaagcatgacaattctgattccacagccagtatgccccacttctttctatgttagcagcaggctagagcgataaggccagacgaatatgcctctacagagctaagagcatctagtgtttgtgcattaaagttcttatctggtacacatgagttcttgaaaaggttccatagtcaccagaaagcatgctgccctctccccatccctgcccgcccaccccttgccttaaccctcctctgccaggtataaaagtgagttggctgatgaaagcattaacaaaatttaattcttcttagagtaatcctctactatttgtacaaatagaagttgtctagagcatttgcctctttgaaaaagcagcccaatgtagtggtaagacttcatagtctcagaagattatagtcctagctccataaccttgcaaaatgtatgtgacattcaaaacttcagttttctcgtccataaaataaggatgaaccggtattgacaatctgatgtttttgtatgtaagggtttttataataatacctgtctttcaagactccagattagagataaatatgaagtatataatacatagcaaaagctcaataaaggatagtcattattattaacaccataattgggaatatggttttatccaaaaaaatagcctgagcagttcacattgaaaaccaaatgtagaagttcacagcctgccatgaataaaaaggatcctagaaatcacctggactaaccccctcacttgacggatgaagggctggaggcccagagaagtgtgtcatccatcacactgccaggcaatggcactgccaggcaatggcactgccaggcaatggcactgccaggacaacctctgctaccgtgaattgcaggcaccacgatgccactcagcaatgcagcatggactgctttctccactccaggatcccttctggaccaggtgatcactttcttcccttgtaagctacatcaggacatccatagtaatgtatcttcccttacttctagagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtaagaaagctttatttgttcactagggttgagttcagaattaccaccacaacacaccatattatcaccattttgcacttggcaaaaaagcagtatcacttggcaatacagtgcctgagggctggcctatgtagcaactgggggttaaagaaacaatgagtccacgcaatcataggcttggacacatgctttgggtttgatttcacattaagactgatcagctaggaatccagccagagtaattcacattaaggctgatcagctaggaatccagccggagtaattccgtcacatcttgacttagcaggcatggagttcatgagcctaagcagttaccttcgcaggcatctagaaaacagatggaaacaatttcagaggctggaagttcttccatgttacacaatcactgtcacttggagcagttgtgtagtcacagactcagaaacgaaacacagtccaagggaggacagtgagtcccagagacgcttccagagagatgatgtaggttacaaatggatgtaagacatacaaacatctaaccagtcccggatcacagagagggccctggaagtcaaggggacagggaaggcagatgattccctcataagtttaatgaactcactttgttctttggctccatccaaagtctacttactctcttgattaggaaatgttttctttctgaatttattagcaagatctttgttttctctccctaattgtatcactttgaggagatgggacactgtgtgctctgccaggatttttatctctgaggctctggtctcctggtgcctgaagttgatgcagttatatactaaggggtttagaccagaatgcatttctcttacattattaaccccacatcccacctactgtctatccctggggctgtttgtttacttcaaaactcagtggggtacttaaggcactctctttttaacaaaatgagtggaatgaattccccttctgaatctgcttttcttcaaacaagccatttgcattatgatgtgaaaggtcccttttgttctatgtctatttgaacttgagttttttggtggtatcctgttcatgagggtgtgagcattgaaaactgccttgaaaagtggttgtagggatgatcttagtcacagagctgtgacaccatccacccatgtgacattttgtcctcactggtggctagaacctattgtgtccagaattggtgggttcttggtctcactgacttcaagaatgaggctgcggaccctcgtggtgagtgttacagctcttaaggtggcgcatctggagtctgtcccttctgatgttcagatgtgttcggagtttcttccttctggtgggttcgtggtctcgctggctcagcagtgaagctgcagaccttcgcgtgagtgttacagctcttaaggcagcgcgtctggagttgttcgttcctcccagtgggctcgtggtctcgctgggctcaggagtgaagctacagatcttcgcggtgagtgttacagctcataaaagcggcgtggacccaaagagtgagcagtagcaagatttattgcaaagagcgaaagaacggagcttccacagtgtggaaggggacccaggcagattgccactgctggctccggcagcctgcttttattctcttatctggccccacccacatcctgctgattggtagagcggagtggcctgttttgacagggtgctgattggtgcatttacaatccctgagctagatacaaaggttctccacttccccatcagattagttagttacagagttttgacacacaggttctccaaggccccaccagagcagctagatacagagtgtcgattggtgcattcgcaaaccttgagctaaacacagggtgctgattggtgtgtttacaaaccttgagctagatacagtgtcaaatggtgtattcacaatccctgagctagacataaaggttctccaaggccccaccagagcagctagatacagtgtcgattggtgcagtcacaaaccttgaactaaacacagggtgctgattggtgtgtttacaatccctgagctagacataaaggttctccgaggccccaccagagcagctacatacagagtgtcaattggtgcactcacaaaccttgagctaaacacaggatgctgattggtgtgtttacaatccctgagctagacataaagactccacgtccccaccagactcaggagcccagctggcttcacttagtggatcccgcacaggggctgcaggtggagccgtctgccagtcccgcgccatgcgctcgcactcctcagcccttgggtggtcgatgggactgggagccatagagcagggggtggtgctcgtcggggaggctcgggctgcacaggagcccatggagtgggtgggaggctcaggcatggcgggctgcagtcccgaggcctgccctgcgggaaggcagctaaggcccggtgagaaatcgagcgcagcgccggtgggctggtactgctggtacctccgcagccgctggcccgggtgctaagcccctcactgcccggggccgcaagggccggccggcctctgcgagtgtggggccagccaagcccacgcccatccggaactccagctggcccgcaagcaccgcaggcagccccggttcccattcgcgcctctccctccacacctccctgcaagctgagggagccggcactggccttggccagctcagaaaggggctcccacagtgcagcagcgggccngaagggctcctcaagtgccgccaaagtgggagcctacgcagaggaggcgcggagagcgagcgagggctgtgaggactgccagcacgctgtcacgactgccagcacgctgtcacctctcaatattcccattgatgctggtcttggatcagctcaacggttactgcatgtatcaacattaaggattttgaggattaaaatttctctttgttatctttagtgttttctgctattagaatataaacctatttcacatggttttggtttgttttgcaggtgttttattcttcccaatgactctatccattgtgagagagaactgtaccaatcggccagagcgtggaaggaccataaggcatacattgacaaagaggttagccatggctatgtgactgtcagatatattccaaactcaaactcggcctgccagccctgctgtgtctggtgggacataccacagatacacatcatctataattatgtgaaaaaatacaaaaaaaaaaagttatttgtctttctccagtgatttaatgatagtcctactgaaaacaatatagagtatgagaagagactgggaactgactcaatggtcttttgaaatctctgtgagaaaatgattcagttataaaagaggaatctgctaatgtttatctataacacatgggttggaatatagagtctatatagacatattctatgcccagtttgtttctatgttaagtatcatctcagatgaatagctgttattacagaacagagaaaacaaggtgaaaagaaaagtactttgtaaagaaaatcctgatcttaatacgtaagtgcttgaaaacatgttttccagattgaagctctgcaagataaaattaagaatttaagagaagtgagaggacatctgaagagaaggaagcctgaggaatgtagctgcagtaaacaaaggtgagcttgtttccatccatgctccactttccaaattcatttccgcacaagccagaggcattagcactgggctcatttttctctcttacctatagaatgtattgtcatagagtacgataacctaagctatttaagtaaaactaaatatgcttaaacttaagcagaaagtaaaaagtcacattcagctaaaatacttacaacatcactgccttccttctttctattttgctttctttttataaaatgaacactttgatccaatgcaaggctatgaagtctcactttttaatcttctctcctgcagctattacaataaagagaaaggtgtaaaaaagcaagagaaattaaagagccatcttcacccattcaagtaagtaactctctgttttccacatttgctgggagtcaatgactgtccacctggcccttcgaagaggctggagggacccctgtgtttcctgcagtgccgcttcagaagaagtagatccatctaggagggcacctagctcatgaagttgaaagcaaagccccacctcaccaagggaccgtggcaatgctcttggcatcctttgttggggaggcttgctgaactccactgtcattctgtgggtgctccctacctggcagatgggaccagtaactagattttactccatgcactgctttctgtggagagtgcttgagggttacagactctctcgatgcagttggtgttctacagagcagcctggaatagtgctgaattctgaaagtgggaagaaatataaatttttttaaataatagcaaaatttgcatgtgaaggagatttagtatttaaacttcaacaaagtttaagccttttatatataaaaaacaaaataataaaaaataattctaaaaaataaaggctatctaaacttgtttagtagaatttgtcaaagaattttttaaactttttaatccaagccatctgattcaactaacctttaactcgatggctgattggtactcggctgccaaaaaaatgagccatttgtccaaagagtgtggctagcaggatcctgtcattcacattaacatttatttccatcgatgtttccatgcacatgaggaggaaaatgttggtcctcttaggttcaataaggtcccaagaaagctgtcactgaatgcatttgcattcagtgttccttttttgttgttttttcgagacagagtctcactcttttgcccaggctttagtgcggtggtgcaatcttggctaactacaacctccacctcctgggttcaagagattcttgtgcctcatcctccctagtagctgggactacaggtgtgcgccaccacatccagctaatttttatatttttagcagagacagggtttcaccgtgttggccaaactgatctcaaactcgtgacctcaagtgatccgcccaccttagcctcccaaagtgctgggattacaggtgcaagtcactgtgcccagcctgccttcactattcctgattctattttaagtccctctatacaaaatgaaggtcgtccattatctcttatcaaggcatctaaatatttgtgcaagactcacagcaacaagcctatttgtaattgagaaagtgccttctgaacactcaaaataatcccttctcttggaacagggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaaccgtaagttgcttgttccaaatgccacttcctgccgccatgcagagacagcgactcataacttagatcagaaattcagcataaaatgaggaatctacaaagattcaagagaaaggcatcatattctactctatactggaaactcaaatgattttgccatgtattactgttttctttaaattttttctggcattttgtttggtaatgccaagcttctccctggctttttcctcctgatgatgttgtttcacataatacccagcacctggcacagtttttacccagtagaactgttctatagctaaataacgcaagggatgaacatcccgtaaatggatgaacaattttgccccaaatagattttgtttctgctttatttcaagtacataagtgtaataaaaggaagaaaaagaatggtaaaagcctcttaaatgcagggcccatactctacttattctcagtccacttcagtaccagcactagacttgtagaataatagatactctacaaaattatttggttttacattgaactgctaaggatatggcataataacatttgtgcacttttaaaatagtgcttatattttctttagtggcctgtgcacattattcactgaggccatatagaagtaataccccacattcttatagtacatcctctgattgaagcttaccagcctatagagtagatgaaacacaaaatcttctaactgagaagctcactggagaccacccgggctactgtttctcaaactgggatttggagactccaaagaattgatagaccattcttggggggatctagggcttgtcctaggagactttatgttttccctttccattttgatgtctcttgatttcagggtccatgtttgcatttctgtttaaaatcacatcgaggccgaatgaactcttaaagtcacagcatttaacttttaatctagtttctgaaactgtggtgtgggaatccctgagggttattcagatcgctggggacagtaactggggacgcaacatctagcaagacactttattttctgtgctcatattttaatggggtacaggtagaaaaaaaagaaagtaaatgaaacaaaataattatgagttgtagtaatgctatgaaggaaacagtgatcaacattgttttttattattatactttaagttttagggtacatgtgcacaacgtgcaggtttgttacgtatgtatacatgtgccatgctggtgtgctgcacccattaactcgtcatttagtattaggtatatctcctaatgctatccctcccccctgcccccaccctgcaacagtccccggtgtgtgatgttcctcttcctgtgtcaacatttttaaatgggactctttcggagagcgtggggaagacgggtctttgaggtgaaatttaggctgaaacctaaaggatagagagaagcgatccctgtgggagggagcgtgttccaggcagagggaacagtgcaagcagaggtcctgagggagtctcacctttggtttatccaggagtggaagctccttgaaagctgaagcattgcaaaacacagggttatagttgcttatggcagaaggaggcccttcatacctcntatctgctttttatcatctgnagttgaggccatcctgctcaagccaccaccatttcttacctcggccactgccagacctcnctctgtggcctcccaggctcccctctggtcctcaccagtccatcctgctcagaggagctagggtgatcttttaaggacacctgcttttcttaagctaaagagcagaatcccttcacctgaccccagaaggctgaggcttcagtgagctgtgatcgtgccctcacactccagcctgggcgatagagtgagacgctgtctcaaaaataaaataaaatatagcaaaatccttaacatatccaacaaaaccccatatgctcctatccaatcttacactgggaccattgcctcctgttcttgcctgcttcagccactcaacttctctttattccacaagcatctcaagctccctctcgccatggggcctttgcacttgtttcccctccctggaaggctcttgcccacagccccgtgcccagaaaacactactcacccttcagacctcaattgcggtgtcactgctcgtggacaccctctctgtgcctcagactagggtccgcccatttgatacgctctatcagcaagctctgtttttcccccatgggacgtatcacatttgtaatcatagtttttttgactactgtttttgcttaactgttgtcctttccactagactgtgagtttctcaagataaaaaaccatgtctctatgatactgtattcctgacccaaaggaattgcttagtcaattttaggtgaataaataaacaaacaagcaagccaccctgtccagatcaaatcaactcatgtcaatttaacaaagctttgagtgcctgccactgggtgtcactgtgctggtgagtgaggaacgtgcctgccatcactctgctcttgtacacaggagcgaattaggaactgatcccattcaataccaaatttgatgctccttctgatacacaatgtattcttggtgctctggtattctaggacagtggcttccagaattttttcccaaaaagccacagtaaaaaaatgcaccttatatcaggatcctgtacacatatgtgcacatacacaagtatatatgtgtatctgtgtgtatatgtaatatatatactaaagtaaaaatttcaaaaaagtaatactatgtgtgctatgcttaaatatttttatccattttctattacatattttaataatattattgctgtattcctcatatttgctatgtcaacttaagcccttggcacagtgagactcaataacatgaaaaaaagaagaagaaaagaaaagtcaaatccacccaggcacaagatcctccaatgcaatggtctctaaacatttttttattatgtacccatatcaatttttaaaataaacacaccgtctatatttcattacactaatatacaaacatgcctgtgtattatgaaaatatacaaaataaaaaggccaagaacagcaattcatgcctgtaaacccagcactttgggaggccaaggtcagaggatcagctgagcccaggagttcaagaccagcctgagcaacatggtgaaaccttgtctctacaaaaaaatacaaaaattagccgggcnttnggtggtgcccgcctgtagtcccagctactcgggaggctgaggtgggagaatcacttgagcatgggaggtgaaggctgcagtgagccatgattgtactccagcctgggtgacagagtgagaccgcatgtcagaagaaaaaaaaaaaagaaaagaaagaaaaagaaaatacacaaaatagaaatgtaaagtttgagataaacgtttaaaaaagagtttttaaaaatagttttcatattctttggaggtccaaaacattttgttctcacttattaaagaatgcttaaggaaaacaaatctcagtgtcccacttaacaatgcagtgagacattcagtttatgtttgatgtgtgatcttaattgctttcatatgaaacatgactcagaaagattttctggttccatagatgtgcttcacggcatgctgagtcaatcaggacattctttttttttttttttttgagatggagtttcgctcttgttgcccaggctggagtgcaatggtgcgttctcagctcactgcaacctccgcctcttgggttcaagtgattctcttgcctcagcctcccaagtagctgggattacaggcggccaccaccacgcctagctaatttttttgtatttttagtagagacagggtttccccatgttggccaggctgacctcacctgagatcacctgacctcaggtgatccacccgcctcggcctcccaaagtgctgggattacagatatgagccactgcacccggccaggacattcatttatttatttattttattatttttatttttattatattttaagttctgtggtgcatttgcagaacgtgcagttttgttacataggaatacacgtgccatggtggtttgctgcacccatcaacccgtcatctacgttaggtattttttaatgccaccattaactaggcagtcatctctattgaaattacacttttaaatgtctgtcctccctgagattgatcaattattcttgcaaatacaaaggtattgtatttgtatatttcatgaaacaagtttaaaacccatttaaacggttaatttggaagatttctacacagattagaaaatttgggttccgtggtttttaatgtatgtagatgtgagataaatgttcacatataaataatatgttataaataacataattagagatcttttaatgaaaagtcgtataatgatgaaagcattttcaatcatccatttttaagatattatcttttcttcacctgtatttgatctaatctggttcattcaattcaatttaggattttttccccacagctaccccttcatatcgtttcctataagctttaggtctttctttgaaataagcatatgtagtttgttatctgatttgttaatatcaaatctcaagtattaaggctttttaatgttttgatataatttagaagttctttagaatagatggttttcattaggtgacattcctagaattattgtcataagttattataaatgtggtaacatattttacttaaagggtgcacatctattacaaagactgtttgcgttaaataaaaggtcagaaaggatatgaaaagtttaagagcgtaaaagttggctgggcacagtgactcacacctgtaatcccagcactttgggaagccgaggcaggtggatcgcttgagcccaggagttcaagaccagcctgggcaacatggtgaaaccctatctctaccaaaaaaatatgaaaattatccgggcttgcctgtagtcccagctacttgggaggctgaggtgggagagtcacttgagccccagtggaggaggctgcagatcacaccactgggcgacagagtgagaccctgtctcaaagaaaaaaaaagagagagaggcggagagaataaaagttttaagttggagaacataatgtgtaaaaaaaaatttttttctttttgagatggagtttcactcttgacccccaggctggagtgcaatggtgcgatcttggctcactgcaacctccgcctcccgggttcaagtgattctcctgcctcagctgggattacaggcgcctgccaccatgcctggttaatttttgtatttttagtagagaaggggtttcgccatgttggccaggantggtctcaaactcctgaactcaggtgatccgcccactgcagcatctcaaagtgctgggattataggcgtgagccaccngcacctgaccgtgtaaaaatatttaaattagctaatcaactaaaaacaaaatcattcctggagggagagagggttgaataggcagaacacaggatttttagagcagtgaaactactctatgtgatacaacaatggcagataaatgtcatcatgcattgtccaaacccagaggatgtgcaacaccaagagtaaacacaaatgtaaactatgaactttgagtgacaatgatgtctcaatataggctcattgattgtaacaaatgtgccaccctggtgagggatgtctatggtgagagaggttatgtatctgtggggactggggttataaataagaatgctctgtacttttccctcaaaaccgctctaaaaaatagtctattaaaataattttttaaaatcatttctcattcattgtttaaaacatctcttttagcctaaggggacagatttagtgtgtctgatactacataggatagcagagtctagtaattaagagtaaactcttgcccgggtgtggtggctcacgcctgtaagcccaacactttgagagaccgaggcaggcagatcgcttgagtgtcggagttcgagaccagcctaggcaacatgccaagaccaatctctacaaaaaataaaatattagccgggtgtgatggtgcatacctgtagtcccagcaccacaggcggctgaactgacaggatcacttgagcctgggaggtcaaagctgcagtgagccttaatcatgccactgcactcgagcttgggcaacagagcaagaaactgtctcaaaaaaaaaaaaaagtaaactctgtagccagatcccagtgctaccagttgtcagccaggtgaccttggacaaattacttaacatctccttgcctcaggtttttccatctgttaacatgaggatgataataataacctctgtctcaagaggtagctttggggattaaatgagttaaagtacatagtgcacaaggaatgctcattacgtgtacctatcctattaggttggtgcaaaagcaattgcagtttcagaccgtgaattttaaatcattataactgggctcaaacacatctttctcaatcaaaataggaaccattacacccaacgcattttcgccacgagaaataagtttgtttattcctgtagcataaaaattcatgtttcagaccgggcgcggtggctcacacctgtaatcccaacactttgggaggccgagatgggcagatcacgaggtcaggagatcaagaccatcctggctaacacggtgaaaccccgtctctactaaaaatacaaaaaaattaactgggggtggtggcgggcgcctgtagtcccagctacttgggaggctgaggaaggagaacggtgtgaacccaggaggcggagcttgcagtgagccgagatcgctccactgcactccagcctgggcgacagagcgatactccatctcaagaaaaaaaaaaaaattgtgcttcaggattcaatgaactcttggaaagcattttctacgttctgctggttgtggaagtgttttccctacagaaagttgtcgagatgcttgaagaagtggtagtcgattggcgagaggtcaggtgaatacagcagatgaggcaaaacttcgtagcccaatttgttcaacttttgaagcgttggttgtgtgacattcagtcaggcactgtcgtggagaagaattgggccctttctgttgaccgatgccggctgcagacattgcagtttttgatgcatctcattgatttgccgaacatacttctcagatgtactggtttggccaggattcagaaagctgtagtggatcaaaccagcagcaggccaccaaagagtgaccgtgaccttttttggtgtgaatttggctttgggaagtgctttagagcttcttcttgttccagccactgagctgttcatcgcacgtcacaatctgattaagaaatggttcgttgttgttgcatagaataagagaagacaacacttcaaaacgacaatattttttattttcctctcagctcataaggcacccacttaccgagctttttcacctttctgatttgtttcaaatgccaaatgaccatagaagggtcgacgttgagttcttccacaaattctcatgtagctgtaagaggatcagcttcaatgattgctctcaaggtcattgtcaacttccaatggtccaccactacactcctcatcttcagggctttcatctcctttgcaaaacttgttgaaccaccactccactgtatgttcgttagcagttcctgggccaaatgctttgttaatgttgcgagttgtctccgctgctttacgatccattttgaactcaaataagaaaatcactcgaatttagtttttgtctaacaccatttccatagtctaaaataaacatgaagagcaagtaatacattattagcaaaaaaataaagcaagaaatgcccattaaaatgatgattaatataaccacatttattgaagaatgtattccaatatcaaacagcaaatttcaacaatgcaaaaaccgtaattacgtttgcaccaacctaatagttgtttctaaaaaaattttgctgggccaggcacagtggtgcatgcctgtagtcccagctacttgggaagctgaggatcacttgagcccaggagttctagtccagcctgggtaacatagagagaccccatctcttaaaaaatacttgttaggcagcacatttctgaaattcaagaaaggtcagcaaatttggaacatgtgcccttttgtaaacagaagagtagatgagttgattataaatgggacatctcttctgcatacattctacaagttaaccagagggctatgtggtataaaagatgtttgtggtcacagcctagctcaggctagagtgttgcagagaccatcccaaatcctccaggctgggctcaaggcttctctaaacccttctttgttgcaaaatcccatcttttcatgcttcattggtgacatgtggccatctgccacatagaacaagtgagagtactagttccatatctttattaaataaccatttttcttttgtacaaagaataaatagaaattctgatatttttcttctcatacttccgtcactcacccctctttggaaaccactgcataacagagctaaggggaggataaactaatgtgcctgaaattttactttagtcttcagcctataagagatcactatcttttttcccattttcacctagtttcacagcaaatttacctacggggggaaaggtattattattcttaacatgaaaccacaatatttataagaaagaaattgtgaactttaaagtgtaaagataagggaacactggaatggcaagcctgcctaaggtttttcactctttttgttttgttgtgtttttcttttttacccaacagtgggatctttctgtgcttgcacgagttctaacaataacacctactggtgtttgcgtacagttaatgagacgcataattttcttttctgtgagtttgctactggctttttggagtattttgatatgaatacagatccttatcaggtaagacaatatatgttcattttatgaaggttgttgaaaataggataaccagacataagcttaaatagattgtcctgtctgcattcacagctcacaaatacagtgcacacggtagaacgaggcattttgaatcagctacacgtacaactaatggagctcagaagctgtcaaggatataagcagtgcaacccaagacctaagaatcttgatgttggtaaggaaaaaaatactattttttctattttacctggaaaattctttgtgttactgagctttctgccttggaaacatttaattgcacagaaacatataattcaagatacttagaggagacactttccaggcaattctaaatacaatttgatctctaagtttagctctggtgtactaatgaaaagcttaatccaccaaaagatttggtgagcatttccttccaatatctcccacaggtctattctattagtaaaccttgattcctgatagaagcatctgttggaagatgacacgaaagcgttaggtatttgtttgttattgctgtcaacagtctgaagatatactctgagtaaaccaggatattctctttttttaagagaactttgatggaaagacacaatgctctatttctgctgtcccagtttggagttcccccagttggatccctgcctatgacactgaattagatttcttttgccagtatttttcgtctgaaactagagatattggagcagttcattaacttgggatctaaaaatataagaggatctgaatggaatcagccagatgttccttcccagctatgtgtgttaaactggcttatttctcctttgtttcatggagatgcagttcttttcagtgtccgccccagctcttttctggttaatgaaaatactcatttcctcctcatgatgtctgcagaaatgtaaataccagctgtccatacaaggaaggaggaagaactaaagctggcaagggcatggaccttggcatggcatgccaactccagaagggtgaagagctggactcacaggcacttgggtgcagtttgcaggagctttttgtggtgccgctgggttttctctgtgagtctggtgcagagccagtgtcatcaacagtaaaagtgggcagctttctgggtcacatgccttgaaaggggtagggattcccatcccagaatgatcaatatcaccacctgtcatctcctttccactgcagggtcacaaaggcttttgagttctgggagtcccctaagaaaatataaatcctcagttctcaatcaacacctctcaattaacacttagtggaatcagttgtcagtcaagagcagactgtacttgcaaaataggtcttttggtcactgaccccactcggctcaaatcttttcaaatatcctgcttatctgttgaccttttcctcaaatcttacaaaaaaaagagagagagagagggagggagggagagagagagagaggaaggaagaaaggaaggaagaaggaaggaaggaaggaaagaaagaaagaaaaaaagaaagaaagaaagagaaaagaaagaaagagagagagagagaaagagcctgcaaagacttggaatctcaaccaaccattagaggcactagaaatattatacccagatatttctccccaaaagaacataggacttttattggtggtgacataacaactctacttagtgaaatctgatcgagtcccttaatggtgaaatgacacactgggtggagccagttatgctgtttcacttcaagccgtcctctccaccttccagactattcctatgggagatgattattagcccgtttttttccaatgttttgtctaaaaataaccaaaatttaacttttcctgagaattacatggacttctggaagtacttttcccactgcttttaagtgggctctcctccctttaacacccacccatttttttcatatgaactcttatttttttttttatcttaaaccttttcattcatagctttcaatctgcattttgaacctaataggaaatctctgttgggcttcagcactgtctgtatttaacaccatgtgtttctttctaggatttagatgttgtgcatgaaaaactatatagtgaatggttttataagttctaaagctaacagaaattactcttgtattttcctatatcaggaaataaagatggaggaagctatgacctacacaggtattcacacttttttattcttctcaacagcttcttccccaataattgcatgatccagtggtttcaactaatttctgtttcttaccgtgttgcacagagcaaagctgggggtgcatgcttgttctaacagcattctccactatgttttgtcattgatcacagaactgtcattttgcttttaaatcagctcactgtcccatcaagatgttccagagcatttactcactcccatgcttgtttgcttgttggatgatgcttttaagcatggaatgatgtgaaggaaaaaaaacagaatggcctttgggagccccgggaaagggtgggagatttattttctttgtggtacttacacattgatttggtgggggagcttcatgaaaatgggttggagatttttattaaatatagcatcaaaggcacaaaatgactaatgagaattttaagagcactgtaaggccgaagttgaaggaaacaaggaatttctttgttgatgttcattcattaactttggtggtgaaaagcagcagccgtaagattctgaaagctctgcagagaggtggtgaataacgagaaggtgctgggagttggggacagagtaccgggagtcaagatactagtaaagggccacacacagtggctcacacctgtaatcctagcactatgggagcccaagcgggaggattgcttgagtccaggagtttgagactagcttgggcaacaaagtgagataaaaaaaaatttttaactagccaggtgtggtgatgcacacctgtagtcccagctactcagctactcaagaagctgaggcaggaggatcgcttgagcccaggaggttgaggctgcagtgagctatgatagtgacactgacctccagcctgagggacagagagagaccctgtctctaaaaataaataaataaataaaaaaataaagacactcaatagtgtcaacacagcaccaagacaacacacaaacattccataaacaaccctcagccctgtcattttatgcccctccaaccctcatccatccctcactgtgctctggaggggggacgcacgctcctgatggccgtgtcacttggtcacctggcaatattcgccattgctaattttctactctgagcacagacctcaggcaggtctgccacccgaagcagctgggcactgtccttaccgcctctgctgagacaaaactgaggcacagacgttaccagtaccctagttaatgtatccacttgggagaaaaacatccgtcaaagaaatgtgaacttaattggtgccatctatattaatatcttctttatctatattaatatcttctttatctatattaatatcttcttcatctgtattaatatctttaaaattaacatcccaaagaatgttgctgttcctggtaccctgttcggcccctctaacctccagagctatggtctcagatgcttccttttagagagaaggtcattagtccaccaagaagccaaatgacaacaggaaaggtgatgggaagatgaaaacaaaggaaggtggacttttgggtatatgttatagccatgtatgtatgtcttcttttttctattttctcttgttcttcatcttaactgtcctcaatctgccccacaccaaccctgtgtcactcccagcacacataagacagagcagaagaccccatccttgagctggtctcccctgggtatgggctgaggtaacatcccacacaccaggacgatcttccctgcctcccatcggtcacattaagacattttcaaagtgtaatattataaatggacctacctctaaatattgactttacagttattttatgaggcactcaatttatagctaagggtttttcagtctagtgtcatgaaagagataaaagggtgttcacagattatttaagacataaggctggtcagggatgagtcagagagtcattctccatgaagtcacccctggccaactttgaaaggaagaatgtttaactgcactttgggcgtaaatgacaagcatctgggaccctccccttccctgatccctgccaccaccactcaatcggccagataatcaattgtttctgaggtcactttcacataatcttggcaactttagttgttgaaagcatgcatgcaggggcaacatggtgttacctgttgctttttttttcccccttctaagctccttaccagagagcagatctaaggatactgtgtaacttgaaataaccggcattttcagactttgccatttcatagtccatagggcaagccatctttcagtggatatccacatggtgggcaggaaatcttgacattggtttctcagaaaatatctgcctagtcacacctgggaattcactaaacacccaaatgcagtgtttgatgtggccttacctgctccttgtatcttattggattgaatgagaacagatgcaaaacaagtatgtacagaaatgccaggaaaactactgtcttccaatggggttcaacagttcaaagccctccattgatggagccacttaggaggtttcagtgtcttaattcttttagattttgacagttttagaaaactaaaaaaaaaaaaaacaagtttttatcgtgaaatttgattacaaaagattttgagagaaatgataagaaccagatctgaagaatttgaaatttgaaaattcagcagagcatttttttaaatgtatcttgtacaagatgaactaaataaatgtttttaaactgacttctttttggtggatttcaaaagttaaccttcagacttatttagagggttttcataaagcaagtttttttctgttgctgctcaatttctttcttttcttttctatcttttcttttctcttccttttgctgttccctgtgtgtgaagcaggaggggcagctgaaatgctttgcatactcaccctggtcattttccagttaggacaagctcaaagggagagcacagctcagaaggtggcactcatgactcaggaaataatttgtggctcatttgaaagcagcatcttctaagtgtgttgcaaaatagagaaaaatcaacaggttgttggggtgtttattttccccactgcgtatgaaagctggtgctgctgccctttgatggccaagaggagctcctggcagccgtggccatgtgtcccgggggtgtgtggggcaggcggtcagttcttggcagccttcctctggcagggctgcttcctgatcctttgcttcaagccttctgggctgttagaccacacagagctccaccctcagcagccacgctgtaaccacattgctttcactgattttgactcatctcccccatagtgacagtgtgtgccaaaggtggctgtgggtgacacagccgtgtgttcgtgctgtacggcactgtggtcatgggggtggacgctggagctcctgattagtttgagttcaaatcccagcctcgctggtgggcatgcttagaacagaccctagcaggcgccaagccccagtaagtggtggagtcattggtaaaggataatgctgaatgcaggacatttatatggatgaaagagtatgggaaagggaatttcagtgatatgaattccaaagcgtgttagtatattttataagaaacaaaaaggtattcaccagcaccaccaaactccatcatcagtcacaggcaaccaagaattgatcactctcccagaactttgggaggccgaggcaggcagatcacgaggtcaggagatcgagaccatcctggctaacacggtgaaaccccgtctgtactaaaaatacaaaaaaaaaagaaaaattagccgggcatggtggcgggaggctgaggcaggagaatggcgtgaacccgggaggcggagcttgcagtgagccgagatcacgccactggactcctgcctgagtgacagagggagacgccgtctcaaaaaaaaaaaaaaaaaaaagaattgagcactcaagtccgtcttctaaactgcctgaacctcttgagatgagaagaacaaaacaaacctgcgctgtcctgatgtaggttaccctaatggagcttcctgggttctcctctccctgtcacatctcagggactccaccttattttaaagctgtcttactagcactgttggacttttctgtttcagatgctcaaacaagagatggagcaggggcagggtttggggttaaatgggctggaggtgagattggcccccctaaggtgttgaggacacttggggtgaaagtcgttagggtatatgtaggtcagagccagggccgctgcgtgcacagaggtgtgtcatggagcggccagtaggcaccaaaatccagccaaagctcggccatgagagctgggtagcggcaggggtgacaacagtggccaccctggtaaggttaaggtcagacttgggttagtctaagctgtcagagggtgttcatcatttttcttacctttccaatagtgaccctattccaaaggccttgtttcttgtgccagagaagaaactaaagtatagcacgtgcagaactccttaagatcctccccaggctgcggaatgaaatgtatctttaatcagttccaatatatagggggaaaatgtgccctcattcatccatgcaacatataaagacagaaagaatcgaaacaaccacctctgtgccaaacgccgccttcacagggagtgcagtctggtgttagaatgcacgatgcaaagtgccttgaccagaaatatatggcgtcataagagccaggagagggccccaacccaaccctgagaaatcaaaggaagctttccaaggagttggcatttatgccgcatcctgaaggcaacagtgcagtgatccagacacaggatggaaaaggaagtcagtccaaccagaaggcaagactcgtgtggggacttatcatcagttccgtgacagtgcaagggaaggagaagagaaggatgagctgaaaaggcaaccagggcctattttatggagtgtgttatatggagaatgatgatatgatgtatcttccaaacagggatgttttgaccatgggggaggagtactaaaaatagttaattatttatattaattattatttatattaattctatataaatattgttatgtatttgtttaccaatgaactagtcagtagatctataaaacagttgtatttaaaactattttctaagctaaaatgtcaaaaattctggacaaatgccaaaatgaacagggtaccagtacagcagatacaaactgggaccctcccaggcaaacgaaaaatgtggtcaccctagttacatgctacatcaaaggatgtaatccctgtcctaaaagcaataggcagacattcaagagtattaaactgggagaaataatatgagaggatttgggctgatcagattaggtggcataaatagttatgagaatagttttgtgagtcacattggtttgtgggtcagttctggctccatcacttcccaatttgaggaccagttgctaacagtattacaacacttactgtggtccagcgctcttctgaatgctttcgtatattaatgtatgtaaccctctcgataacttcgtgaggtcagtactattattatcctcatttttttttttttttttaagacggagtctcacactgtcgcctgggctggagggccgtggcaccatcttggctcactgcaacctccatctcccaggttcaagcaattctccttgcctcagcctcccanggtagctgggattacaggtgcctgccaccacacccagcttattatccccattttacagatgaggaaattaagccacagagtgactaaataactttcccaagattacacagctgataaatggtgaaattcaaacccagcgagtctggttctagctgtgctgttcatctctacactatactgattctcttggacaatttatttaacttcttttattatggctgaattttctcatctttaaaaaggtgataatacatacacataataatacacaaggatttcatgagatattacctgaaaagtaagccctgaattcatattattgtatgactgaagtttgataataaatttgattagtgagagacaaattgtatcaaagagccctggaattttttttttttttttttttttttgaggtggagtcttgctctgtcacccaggctggagtgcagtgacacaatcttggctcactgcaacctccacctcccaggttcaagcaattcccctgcctcagcctccctagtagctgggactacaggcacagaccaccatgcctggctaatttttgtatttttagtagagatggggtttcaccatgttcgtcaggctggtctcgaactcctgctcaagtgatcctcccacctcagcctcccaaagtgctgagattacaggtatgagccactgcgcctggctgagccctggaattttgaaggacatttatcttcacattaatggatgacaaaattgcagtttttaatgtcaatgctatattaataaagaggaaaagttatgtgcatttaccaataagtagatataatcagccattaaccacacacaaggtagtcatctataaatgacatatatatttatttctatttttagactatctttagggttgaacattaattggctttcatttgtaaaataaatagctattcctacaattcatccataaaattatgtaggttagaaatttatggtcttctggttgctctgcctgtggagtagccattttttattcctttgctttcttaataaacttcctttcaccttacaaaaaaaataaaaacggctaggcacagtggctcacacctgtaatcgcagcactttgggaggccaaggtgggcagatcacctcgttcgagaccagcctgaccaacatggagaaaccctgtctctactaaaaatacaaaattacccggacgtgggtggtgcatgcctgtaatcccagctactcgggaggctgagacaggagaatggcttgaacccaggaggcggnaggttgcaatgagccaagatcgcgccattgcactccagcctgggcaacaagagtgatactctgtctcaaaaaagaaagaaatttatggtatttttactatggccaattctattgtttggttgtcctgctnnnnnnnnnnnnnncnnnnncnnnnngctnnngnntnctnncnggncgcccnnnncngnncctgtgccttttccngccctcggtcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaatcaataaggccgggggcggtgactcacatctgtaatcccatcacttgggaggntgaggcaggcagatcatttaaggtcaggggttccagaccagcctgaccaaattggtgaaacgccatctcttctaaaatacaaaananaattagctgggcatggtggccnnngccngggnnggcccnaaanattncagaccttgctttcgctgtgtatcttcgctttgttttggagttcaaacatattatgtttcaagtagcatgaaaatcacccaagatgaataccagtttggtccaaatattggaaaccctgtgccttcagaaaaaaaaaaaaaacaaagagctcagcaaaacatggaagggcttaggagaaaggagcagatgtattaacgcagatagtctgttcgggctcttcccattgtgaagtttaaattagtaccattagaaatgagacttggaagagaatagctatattaattaaaatatcctgccagatagcaacaagcaacaaactacatataatgctttatgatttttctgatcgacccattgcttgcttcttgaaactgtagacacctggcccggtgaaattcaatttgctactgagcacaggtacccagaatcaggtatagatgatgccataatggaggggttcacacaacccaggggaacggccagagaggctctgtggaggggatgagagctcctcttgaaggctgagagctgactgggctaatgaggcagggaagtacattctagaaataaatacaaacactgaggaaggagagagcctggtactttcaggacattgcacttgttcctgtggctggtacagaggtgatgtgccaaaggggaagagaagaggccacagaagctgcagaagtcagcctgtgtctgcagaaacaatcccttctgcttcttatgacaccatcagcacctgttaattataacactgctccaggtagagttaaaattccatgcatgcatgatctcttaaattacccgtctgtggaatatagcatgatgtaattctgtggttaagtttttaaaagtaagtaagtgtcatccagaaagaaatgtgacttggcttgcgacctgggtatgttcttgaatttgtcttaatggattcacggcttttctgtttccgggattggggaataattatctgtaatgtgaaatcatctacatttattctgaaaattcacctgtcagaacaagcctatctataccttttctctctgaataaacagcttccaaacgaccaaagaaaaaggtttccttttttgagctgaagacaggcagaaaccaggagacacatggaaaatttaagttctaatgtcgaataaatttaactttctattttgatataactttacatttacagaaaggtcgcaagaataatttcaagaactgttaccccatttgctttattgttttttcttgttctttcactcactttctccacacaccttttttttctgaatcatttgcaagtaatttgcaaacatcattcccctttatatataaatgctttaggaggtatttccgtagaacaaaaacattctcttacataactgttatgcatttatcaaaatcaagcaatttaacattgttacaaagcaattgtcaaatctacatttcatgttcaaatgttaacaattgtcccaataatgccatattcatcattttttgcttttctggcctgggatccaatccagaatcacacattgcaggaaactcacctctttttagagtattcttttatctggaacagttcctcaacttctcattatcagtcatgatattttaaagagtgcatgccagttattttgtaaaatgtccctctgttggggtttgtctgatgtttcatcaggattgaattgaagctgtggatttttgtcaggaataccacatattgtgctctcgggatatcttatcaggagctgcataacatcttggtggtattacctttgattacttggcaaaggtggagtttgctaggtgaagcccctataatttttttcttttttaattaataagtaattcatttaccagcttttaaggcattcacgattcatttttgcctgaatcatttgttgttaccatgatggttgcaaatgatggtttttccccctctgtaattcctcctgcttgctttttttttttttttttttttttttttttttttttttgtctgagacacggtcttgctctgtcacccaggctggagtacagtgttgcaatcttggcttactgcaggcttgaccccccaggctcaagggatcctgccacctcagcctcccaagtagctgggattacaggcgcatgccaccacactcagctaatttttaaaaatttattttgtagagacaaggtctcactatattgcccaggctagtctcaaactcctaggctcaagcgattctcccatctctcaacctcccgaattgctgggattacagtcatgaaccatcgtgcctggctcctcctgcatttcttaggtagtattgtactgtaaagaagagatttcccggccagatatggaggctcacacctgtaatcccagcactttggaaggctgaggtgggaggaatacgtgcttgagctcagaagttcaagaccggcctgagcagcatagcaagaccttatctctactaaaaatacaacattcaaaacattagctgggcttagtcccagcacctgttgtcccagttactcagaggcagagcttgcagtgagctgagatagcaccactacattccaacctggatgacagagccagaccctgtttcaaaaatatgaaagaagagattttcctcctctcctgcgtatttatttctatcagtatggacttagattctcagtttattccatggatattctcttgctatcattatttattttgatgattaaagtgtcttagattggccactggtgtccctgcacctggattccgtgtacttttgaagcatcctcatcattttttgaccacctcgttgctttctggcctaaaagcatgttccaggttcatatggcatttttgccactccacatttggaaacagccatttctccaaagggccccagttccttttaaaggggaatggcatttgaacaccaagatctgggtctgaggtgtataaaattgctgctgaggtgtcttggcatatagatccttttgatggatagagctaagagacacactggcatctatcaacatctattcttttttttcttttctttttttttttttttgagacagagttttgctctgtctcccaagctggagtgcagtggcatgatcttggctcactgtaacctccactttctgggttcaagccattcttcttcctcccctcccgagtagctgggattgcaggcacctgccaccatgcccagctaatttttgtatttttagtagagacagggtttcaccatgttggccaggctggtcttgaactcctgacctcaggtgatccgcccacctcagccttccagagtgctaggattacaggcatgagccaccgcgcccagcctcgacatctattgttgtacctacagatatgtagagatatgtctaattgagtgacctaatgcttccaatataatgttaccctgctcctgatttcaattaaaatgcttttagagtttctctattaaataagaggcaagctttaggactgagttatatatacttttatcatgttaaggaaatagccatcagttcttttttttagtgcttttatctttaatgaacgttgaatttgtcaaaaagctttttttagcatctatgaagatgctcagataattattctctttagatctattaaattattattgtgtattatattaatagatttggtaagaatgaatcctttcattcctgaaataaattccactgggtcattgtgtgttgctttcgtaatattgaattctgttcactaatattttatttaagatttttgtatcatatttttaaatgataccaatctgtgatttcctttttgtttttaccagcattatctcttagatatattagtttcttattactgctgtaataaattaccactgtgcctttaaaacaacacaaatttattctcttgtgtttctaggggtcagaaattcgaaatgaatcttactgggctgaaatcttctgggggctcgaggcaagaatgtccttgcttttccagtttctagaggctgcctgcattcctcattcatggtctcttctgccatcttcaaatacaaaaatgtagccaatcttcaaatcagtctctcccccaacccccaccttcctctgttttctggggtcacatctcgttctctacccctccttcctaccacctccctttccctttataaggactcttgagatcccactggccccacctggatgctccaggatactcccccaccccaatctcaggatccatgacttagtcacatttgcagagtccctttggccaggtaaaggaacttgtccatagtttccaggaatttggatgtggacatctttgccgggtggagtccactattctgcctatcacagctatcaatgttatccttgcttcgtgaaaagagtttggaagttttcttgagttatctgctctagaacagtctattagtattctcttttcattgaagatttgttaaacttctcctgtgaaagtccacagacctgatgcatctttgcacagtggttctttgggcttgctttttcttctatggaaactgttctatttaagctttctatctatattgggttgttaaatcaagtttagcctaaatctgcctcctcacatattttaagttcagcctaaaggtttctctgtatatcgtgaactataacctaaatagagttgtatacagactgtagcctactcttgtgcccatcactgagttttggcccttcaaaggtggccaactgctcaaactctgttcaaataaggcaaacactgagctgtaaccaatctggctgcttctgtacttcacttttgttttctgtccgtcgcttttctttttctgtccatacatcttcttccaccacgcagctgcgttggagtctctcagtctactctggcttgggaggctgccagatttgcaaatcgttctttgctcaattaaactctgttaaacttaattcagctgaggtttttcttttaacagcatcaatttcggcaaactattttcctgagcaactacgtttcatccaggttttcaaatttgttctcactgaggtctgcaaagtagtctcttgtttttattttttttttaagatggggtttccgtctgtcacccaggctggagtatagtagcaatcatggctcactgcagcctcagcctcctgggttccagtgatcctcccacctcagccttctgagtagctgggattacaggcgtgtgccaccacactcagctaatttttaaatttttattagaggtgagttcttgctatggtgcccaggctactgttaaactcctgggctcacgcaatcctcccatctcagcctcccagagtgctgggattacaggcatgagccacatctcttgtgtttttaattttgtgtatttcaacgatttttaaaatatttaccagtttattataaaggatattataagaaatgcaaataaatagccagacaaagaggtacataggctaaggtccagatgggtcccaaacgcagaagcttctgtccttgagttcgaagtgtgctaccttcacggcatgtggttgcattcaccagctggaaatttctctgaaccctgttatcgtttaagatttttaatgaggttccattacataagcatgattgattgcatcattggccattggtagttaactcaatctccaggcccctgtccactccacagaggtctgagagtcccaactctctaatcatgtggaggtctttctgatgatcagcccagctcccaacctagagctgtctagggtaccctagccatctcctcagcatataaaagacactcttatctccctggagattgcaagggcgttaggatctctgtgaactgggggtagaccaaatacatttttcttattatgccctagtcccctggccatgaaccccgtagtgagaagattataaaagtcaaaagatattggcacattcctagaattgcattcagccatcaataattagtccagtccatcattctgtcatatgaaaatacctcctagggcaaggccactcaggtttgccagcttctgttggatcttgccaggagtggcttagcaatatatgacctcacccttttaggagtctggtataatggagctaagagacaatgtcatctcctgttctgagcctttttcaagctgttaatgtaatattggatttctctcatgactcatgacgtaacccacttattcattccttcagcctcagttactattcctccatctctccatttatgaccaaagttttccaccttcggaagagacattagattcagccactgtgctgctctaggcttcaggcagcaatactagtctagtattatcactagactaccaataataggctagcaagtacctcttgctcagtctgctcccattcaaatagagtaagtttatataggtgcagaactaatgaactgtttttaaccaccaggcagtatacctgcattcactgttaaccccagttttgccagatggggtgaaggcacaacctgccctatcaggcccttaggaattctgacatcgttttaaagtataattagggttttttgcttaggaaacatccctgcttccaacaccagcagttgcatctctgcatcacgtataaaaaagaaagttgaagtgctgtgcagaagacttgcatcatcacaccggcatcctctcctgccccctctcctcttatcctcctgcaaagcagagaaatctgtccagtgggggacactcccttagcccccttatgttgagtgtgaaggtatgtaagccagccttcaatgcttttgtctccccacattttagacagcaaatgttttaactgcccattccttcctgttcttatggaactgttactctaaggataatgtgcaccattatacgtccatttgatgtgagctatctttgctcacttttggacattatgggctataaaatgtgtcctttcatctgaagaaatgtaacttggtggtccaaattagtacagtattttccgttcctatcctgtaataatattttaagcatttgcattgcatttaagtagatgcaatgcttaaaatgggtctacaaaacccagcctggggtaagtgtctatttctgttaagaccctgatctatcccgtcggggctactggcattggttgctcccatgtaatccacttaccagctatgcatggggtgcctaccccaggggaatctgccccatagccatctgcagtctctgactctctttttggcattatatgtctgacagtgcaagaggaataggtccagacttagcccatctctgcatggctgcagcaccaccccccatacccactcattttatgagccccagtggctaccacaagggagcacaccaaaaggtccacttgatggtgcccgtaatactccaatacatattcttatttactcttgctcccttgtactgataacacctattgtgtttctatatatttctcattgcatcttctataatttcttctttatcaagatagttgctcttttggtaattgtctttgtacttacacatttttattgcccttaatccctgttttgtgttttttcttttttggtatttttaatagagacagggtttcaccatgctggtcaggctggtcttaaactcctgacctcaagtgattcacccgcctcatcctccccaaactactgggattagaggcatgaggcaccatgcccggtctaaatccctgttatcttatttaacctttcattatctcattagacagtttttaatggcttctctcactcccagctattacctgaatcatactgaatgagattattctctttggtctgtgctccctctcacatttttagttgcattatttctagcgtgtcctataaaatgcatatattattttttcacacttcttctacctttatttttatcctagatctgataaatctattaaatgtgcaccctctatatttttgcttccatttccccattgatttcttggacaaacgagtcacagcctctggaagattgctgaagaagagctgatgcgcacagtatcccctgcattcttgtgtgtttcaaactgttcctttatagccttgatacttgaaggagatctggactggatatgagatgctaggttcatatttgaatttctgatttcagatggcttttccatcctcatatgcttgattgagaacatttaattcacacagcactggtgtgttgtggttttctgcactttatagtttatttcgccaggagcattttcttaagatggttttttaaattcttgttttccactttatttttgttgttgtcgttgttgtttattttatttttttaagttctgggatacatgtgcaggatgcgcaggtttgttacataggtaaatgtgtgctatggtggtttgctgcacctatcaacccatcacctaggtattaagcccagcatgcattagctattttccctgatgctctctttctcccaacaaccccacaacaagccccagtgttagatagttccccttcctgtgtccatgtgttctcaatgttcggctcccacttgtaagtgagaacatgcagtgtttggttttctgttcttgtgttagtttgctgaagataatggcttccagcttcatccatgtccctgaataggaaatgatctcattcctttttatggctgcatagtattccacggtatatatgtaccacattttctttatccagtctatcattgatgggcatttggtttgattccatgtctttgctattgtgaatagtgctgcagtgaacatacacgtgcatatgtctttataatagaatgatttatattcctttgagtacatatccagtaatgggattgctgggtcaaatggtatttctggttctaaatctttgaggaatcaccacactgtcttccacaatggttgaactaatttatactcccaccagcagtgtgaaagcgttcctacttctctgcaaccttgccagcatctgttgtttcttgacattttaataatcaccattctgactggcatgagatggtatctcattgttctactttcttttatggtaatttgatatagatttaggttcttttatttcatggatttatactatttacaaccctcctggtttaagagaattcttttctgtgagtgtaactaagtatacttcctctttacctttttattttattattatttgggagtgaaagtgagagaggttgtgtgtcttccaacttttcgtatctcttttttcttgcaggatctgaaatttcccatcttttgcttcctctttgttttaccacccagtttccaatggctgtttctcccttctctcttcctttgtgtccttttctgccctaagcaatgcctcccagactgctgccttcaatcgtgcacaggcacaaggctgggacttaggggtcccatcctcattgtcagtgctgtggctcaccaggaatctttacagtattttatgcaaaagattgacgttctttccaccaacagcctccaatcaatctttgactccactgacacttccctcttctctcttccatactgttttcccagagcttgtggccacagtgtgacattcagctctgctgggatttggtgtcaacgttttttatctacacgtgatctgaagattgtaggattctctatcttctagctagaccgaggttgtgggtttggtatagttttgcttattcttcttgctggtctgtatggctttatgggtggtcattgcactcatctaggccacctctttccaaatggtacttaggcacaactagagaacaagtgttattttctgcagggctacagtcatcctggagatgtagaaagatctgagagagagaaagctggtgccttctttgcatatgagaaagtcattcagttatctaaggcacacatttatctaggacatagaactttcagggcaaaaacaacaatcaaagaaataaatccaggcatttgatttgaagagcttaattgcattcagatttgcttttatactgagtgttagggaatataaaataaaaatatcatactaagcattgcctattacattcaaatactttcaaatttgtcattcacccagcaaccttataagtagtaatgattttatcatacaactatttctacacttgacagatgagggagcaagactcagagggactcactcacatgctcttctggttgcaaagttgatttgagtggggccaggagtgaaacccaaatcccctggctgaaaggaccgtgccattttcagcactaaccatgcttagtcatagatgttttcacgaatgtgatcttttttttccccaattttctgttgtttaatcacctgtaacctaaggccactctgtgataacaaatgactaggggaaaatgcttttgagtgtcatacttctcattgattaactctgtaaaaacaatgtaagttgcttgtccaggtaagtagaaagccttttctccactaatgattcaccttcttctctcttttcacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatgaagattgcctgctctctctgtgcctagcctcaaagcgttcatcatacatcatacctttaagattgctatattttgggttattttcttgacaggagaaaaagatctaaagatcttttattttcatcttttttggttttcttggcatgactaagaagcttaaatgttgataaaatatgactagttttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaacatatttatgatcatgaataatgtgctttgtaaaaagatttcaagttattaggaagcatactctgttttttaatcatgtataatattccatgatacttttatagaacaattctggcttcaggaaagtctagaagcaatatttcttcaaataaaaggtgtttaaacttttttctgtttcagagaaatgaacttaaccaagtttttgtggtacacccatttcttgcaagtaaaattgagtcatgatctctatttacatgattgaatactaaccaaacttataaaatggagctgaagtcaatgtgttatagaacgttctcagattaacaacttcaccacggatttacctcattgctgtcttgagggaggcagcagaggcagcgccaaggtagctttcccggcaggcaacctagatggtcacaaagggccagcacttggtttaatgctctgatgtcaccgccnttgaaatccttaataattttttaacaaggggccccacattttcattttccacgggggccctgcnaaatcaggtctgggcagaaccaaaaatggttctgggcagtaaaatggaatttttcaaaaccaagagaacagaccccactgaaggcagtgtcggttcttcaggaaccaggaacttgggtggaaacctnaaancacccttcaagatctcaagttttttgatacacaaattccatatgcttccttctgtctgttccaaatctcctgaagaaatttagccttcaggttgaggggctaaaaatctgtgaaatgtccagagaccagaaggttaaaaataaataagaagaagaaaaaaagaaagcaaagggtcaggggacctaccaatccaacccttggataattgaggaaaccaagttttcaagagaacatagtctaagataatagcattgttgtccaaaggcgcatcttggtgccttgctccttgttcctttctgtaaaatgtgcctgagtcaaatattgccatcctggagaaaaatgcatcttagttccattcaatagctgcatatggagtacctactatgtggcaaggacatgagagggattgcatgtctcccagagctgtttatcggatcttgaaaggcccttagagattggctgcccagctagcctcatttgatttgcgaggaagctgaggctcagaagagctgagcgacttctttagacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcggggcgtcacgtgtctgtcagctgctcctgggttagcgccgccttcacaggccggaactttcacttctctttcccctcctgtttataatatctacccccagccccacctcaacctggagaaatcttgtccatcctttaattcccatatcagttcaaaatttaccttttccttttgtgttcactttcctggactcatcgacccctgaactttttatgtcctgtattttccccttttgtgtgggtattcaaatgctgatgttgtaccaagtctgcggccaatggaagaaaaatcactggccacacgtatcacctcacccttccccactgctgaccaagaaactgaccctcatgtgaccatcattggttgtggtctagttaactcacctttctctcagtggtgttgttgacactgagcacgttgccagcacagtaccttgggccttgtagtgacccctctgctgtttgaagtaagtagagagaatgacttttaaaaatcaaattttctctgttgagaccacagaatccctgagccctcacgttgggggaagcactacagaaagataggggacaaaggaatccgcactaccttactcttcagctggcgaaggtattgctttctgtctgaatttcctggtcctcgtatcagtgggcctccttctggcactcaggtccagaatctgcatccaccaccgggctccccattccttccctgacgtttcccctttccagccccaacagggcgtatgactcagagctagagcggaaccaacccaacctctattaagtttcagcaggagaggggtcatggacccgaccctgccaccctaatctgttttcgcatcactaagagcatcaccccatcaagcccaagaaccagagaacacgatattagcattgtgttttccaaaatgaccactaggtggtagtctagttcaactaaagacatctttgcttggctccaggacccacccctgcaaagcagctactttgatttctaaagtagcagcgcacctctcggtgttaccattttgacaagaatacagctagaacagcttgatccttggcagacttgccctttcttcagtgcttaggatcttagccattccagcaggcgaaagaacagtttttgcttctgatttatattggtattttaaattggaactgcatcaaactttgacgtttcaattcaaaagtgagcactgaatatcgatctccctgctttccaaagtctttgtgcaattaaaaatgttttttagctcccatacactgaaccaacagaggtcatctctgcctagctggcaattttgcaaagaagagcggaactagatgctttttaacagctcttaaaacactgaggttgtaccaagtctggtgctaaagcaaggacgacaagtgaccatattcataacctttccccctcctcatttcttaaaaagaaacattttctaatgtgcctattcaaaaagcccaatacccaaggacgtcatgtctaaaacaccaaaaacaatggccacaaaagccaaaattgacaaatgggatctaattgaactaaagagcttctgcacagcaaaagaaactaccatcagagtgaacagacaacctacagaatgggagaaaatttttgcaatctactcatctgacaaagggctaatatccagaatctataatgaactcaaacaaatttacaagaaaaaaacaaacaaccccatcaacaagtgggcgaaggatatgaacagacacttctcaaaagaagacatttatgcagccaaaagacacatgaaaaaatgctcatcatcactggccatcagagaaatgcaaatcaaaaccacaatgacataccatctcacaccagttagaatggcaatcattaaaaagtcaggaaacaacaggtgctggagaggatgtggagaaataggaacacttttacactgttggtgggactgtaaactagttcaaccatggtggaagacagtgtggcgattcctcagggatctagaactagaaataccatttgactcagccatctcattactgggtatatacccaaaggattataaatcatgctgttataaagacacatgcacacgtatgtttattgcggcactattcacaatagcaaagacttggaaccaacccaaatgtccggcaatgatagactggattaagaaaatgtggcacatatacaccatggaatactatgcagccataaaaaatgatgagttcatgtcctttgtagggacatggatgaagctggaaaccatcattctcagcaaactatcccaaggacaaaaaaccaaacaccgcatgttctcactcataggtgggaattgaacaatgagaacacatggacacaggaaggggaacatcagacaccggggcctgttgtggggtggggggaggg

SEQ ID NO: 24 - DNA, 171936 bp, Mus musculus
gggagagggagagggagagggagagggagaggaaaaaccctacttctgtggctctgttaatggaagcaagctgggagcgattacagagattttcttagatgccataatgctgggaaggccttctgggaaagcagtgtgcccctcaggggtgcccactccagtcctgagggacgagggtggcaccatgtctacagcctcctgccaaggggcctagcaacatgtacaagcccacgtgataaacctaatcaactgtggcgccaggggaaggggtcagcttcgtccactgtgtggtccttccagtgttgctatgtgttcacatcattgtaaaaagagaatctcggggagccaggtcagttggtaaagtacgtgtcccaaggtgtgtgtgcctgagttcagatctcaggacaatcttgcaaaaccagtgagtactgggttcagtgagagatgctgtctcaaaaaataaagtggccatttactagagaagacagaggtaagagagtaacgtcaggtgtcccccttgatcactacctccccccagccctggagttacaggtatgcagtcatccctggctttttacataaaccctaggggttgaactcaggtcctcctgcttgcaagggcagtgctctcccaaccaagctacctccctaacccatcttcattcttttttgttgttgttgttttttgttttttgagacagggtttctctgtgcagtcctggctgtcctggaactcactctgtagaccaggctggcctcgaactcagaaatctgcctgcctctgcctcccaagtgctgggattataggtgtgcgccaccactgcccagcccatcttcattcttaaatgggaaaactgagtgggtggggctggcagagtcagcaaatgaaccacctgccagtcagtggctgagctgagtgcaggctgctagactctctcaaccctagagcagcgtcgagccatggcccgccatcataatcacaatctataaactataatcaaagctcagaagtgatttctctagaatccgaccataaaactagatatactgtcccagagaaagccctagatcaaattacacttacgaacaaatgaattgtacttttcccctcaagaaaacaaagatcccagggctggaaagatgatggttcagaggttaagagcacacactgctttgcagaggaccaaagttgggttcctagcacccatggcaggttgcttataactgcgtataactctagctccaggagacctggtgccacgttcaggaggctctgacgccctcttttggctactgaaggcgttgcatgcatgttcacatacccatacacagacacacagaaatatgtgcagataatttaaaaacaaacaaccaaaaccgaagcaaaacaaaaaccaaacaaacaaaaacaatccaacttgaaaagaagagtctttttgttctaccttgtccagagagagacttctgctttgcccggggcctcgtgcctattttcattgtcaactccatctgtcctcacatgtccatgtacccacacaaacctgggccacacaactgatacagattcacataaactttctgacccatttctccaagagagaccaatggtctaacatcagacaacaagtctgattgtcaccatgtcctcgtggtctttgaagagtgtcttaactggagactatcccactctttccctggtaagaattcacagtaaacaccatcactctttgagattgcccgtggcaattacagtggtttataattctcctccctctcaaactagaccttgattcctaaatgtgcacttttaagcgtcaggcgttagaataaattagactacacaattacatgtaattaaaggggggaaacggccgtggtgatgcaaagatagccgcattttgctgaagtaaagcctgtctgtgaccgtgtgctggcccggagaggccacatgaaatacaattagtgctctgttttaatggaggcctatggagtcgctctcattatcacaatatctgaagatatataaacagcttcttgctaataccagggtatttctcctgacaagacagcttgggttctaactgcgagacttcagcagaattaaccacaaattcatattgttgtgcaagaactggaatttggtttttttttaagttgaaaaaaaaaaaacaaaaccccaaatctctaatatatatatcccctcaagatgcaattctccccatcttcctcctcttcatcaatgcctctgatacagaggacattattacaccttattggtattttaaaagcctatctatctccactcaggagccaggaagtttgagctccaccctggagaagcaagtcacagccaagcatgcatgccttattaaagccacctgtgcccccagaacgtggggcctcagccagagcccccagcctgcagccgtgtccctacggttactgtttcttctttacacgccaatttgtttgagacatgttaaaaggttgtcttttataaccctcataaaataccatcgacttcgcccagatgcagccaaaaaagctgagaccgtctgactcatttcaacctgtgggccaggatgcagaaagacccacaggagttcccgccattgccagagaaccaagggcataacaatgcaaaggaccccatagggtaagtagcacccacgatgtcctgcggagtgagccaccaaggcactgccacagagaaaaagcaaggcataggggtgtcaggacaaaggttctcaaggttaaaccaacaatgggggtgttagcttgagagtctggagttcagacggctccatggttgtatacccagctctgctatttgcagagacggatattaatcaggagcacaggggtcatagaagaaaggctggcctggaccaagtgtctagaaggcaggggctggaaactcaggtcctggggaccctgtgtagcccacccaggccagagatgaactgtagaagagacagtgactccccaggctgggggactctgaccctgaagtccctcacatctttagatcgacacagaagttcttgagtggggccagccgttttcatcttcctggaaagagcccaggcaacaggctgaggcccagaccagcagggttaggtgtgcactaggagttagggggaagtcaattgtcttaactgattaatgattccctgaatcacacacccaggtacacacacacacacacttgtccctaagctctgtctcctcctctgtaaagaagaaaagtggtcaggtgctggcattgccaccactttccatttccattacaacaaagaaacataagagaaatcacatgataccaccctcctccagcgctcagtcccaactgggagactgagaactgccctctttcctggaatttctgttgggcacacccatctacagagagtcaagtctgaagtgcaagggtgtggtcctagtgttttctgatgtaaatccccaacttctagagcattctctagaacctcagagcaaacagggcacagattccattctgcatccttcctgcccagaccgcaataggacactgcagacctgctagaaagtcactgctgaaataaggcatgtggttcaaagccaggtgcagcctgtgggctgtgtacaagcctctgtcatctctgagcatacatgttctccaaaaactatgaatgtacacttcatgtgatgaccaggtgcaaagctctccatttggccacagaacctgctgttcttcctgggaggagaaccccaagccaggatgggtatagcatgtaaagttacctgttgcagaaaaagagaaggatacaaaaagatcaagtgtatacattgttgttgcttcgtgtgcttctgagacagtatcactatatagaaagtttgactttgggtgatcctcctgcctcagccttcccagtgcaggcatcacagatgtgggccacgagaatactgtctgagttgaccctataaggatatataaattaatcaatttaattattcaattaaatgtctgggatgttgaaactgattacacctgcttttctatctgttttattggtttattttctgagatttttttccttttgttttgttttgttttgttttgttttgttttaatagggtctcctggacctccaactggtcttaatcaccctgtgtgtagataagggtgaccttgaattttttattttcctgcctttgcctcccaagagctgggattgcaggcgtgcaccagcactgtacatttgatgtttgtttgtgtgtttgtgctttctaatgaagttctcagaatctcaaggatgggagccctctgccccaagcatccaatgaacagcgctgcaggggcccagccccttctcatgcagcactgagactggaatgcctgggggtggggtggagggtgggggggggggttcatgaaagcgaatactcacgcctaacatcctgtatccagccaggactctacactagccaaaggtggggcttgcccccggcttaggaaagcaagttcagggttagtacaacgactgtatgggcggagtcgagagccccccacgcagtccagacaacccgcttgaattttagataaacagcgaggacgtgattttagtgcatctccatcggtgccctgttatttttactacgtgaatttgacaaacgctatccatcagaaaactagaaaaatcccaccaggggaaggaggatcttgaaaataagcgcagcctggggggtcagatacaactccggagctcagcttcttgggttcagatcctgatccaactatctgaccttgggccaataacttaacggctctgtcttgatttcagtatctataaatggatgaacatcttggaagactttcaggggttacgtttccatccgaggcccgccccgttccaccgcagggtcgataaccccctagcacatcagctgtactttctgaagctactggtgggctctgtgaggctcttcacccacccttggcagccagggccccctcaagcctctggtggcttcggggacggcagaaaccgcgcagacagcaccacctggagtcagagttctccctttaccaagggaaccggcctcccctttctttcccattcccggcccatgtctgggcaacgcttctgctttcgcttgagctcaacttaatttctcagagagcttcggagacgcgtgggaaggtcccaggcgcgtgggcagttcctcccgcgatctagcttggggatcggcccgagccggcgtctccaatggcaagtgtgtgcgtgtgtgtttagaggcgagcgcggggctttcagctaaggctgccgggtgtttgcaaaccagggcgagcccctgtgaaagcggataaaagaaaacatttattaacgtgtcattacgaggggcagcgccgggccggggctgtcgcacgcctcagggaacacttggctcctcgctgctgggagggaggaggacgaaaaagcggaaagaggctggattctctgcgcgccagcccgggggcctgatccatggccctcgcgacttcgcgccggtgtctggtggactaagagatgcgcccccggtccgagtggcacacacgcgcgcacacacgcacgcgcggtcccggctcgccggcagctccctgctcagcgcacatcagcctcaactccgcgcccagggcgagcgggagcgggtgcgggtgagtgcgccccgggcccgcgagggtgcgcgctcggcggcgggagcgcggccggccaccggctcggcaggcagcaggccgggagccgccgggacttcgggccggggcgcggggcggccgcggcggcggaggtgaggagcgatggctgaatcgccgggtccccggcggggcgggaggcggctgggtcctgggtcctggcgcgcgcggaggccggggcgggcggggcgaagcagaagccgggatgccgcggaggcggctggagcagcggcaaggcagagtcccctacgccccgcggcccggcccggctgcggcagagacgcggtgaggccgcgggggccgcgcggtgagtggggcgcggggccgggcccggatcacagattccagggcgagcacggttcaggtgagcccagccggtccccgctgcccggctcagggagggtgttacccggaggtttaggtaccggccggcctcagtggggctgaccgatttgaccccgtctgcaaggctgggcggctaggggaggacttcccgcgccccggtggttcccggggaagggcgcgtggacccgcgggctgcaggagcatggcccggttgaccccttgaggtttagatccagagggccagctagaagccagaccacgtgtggcttgtccgggcaggacccgagcaagcagggactaggaactcgcagaacggaggacaaatgaaatcgtaaaacttctcccgcgccaggtcagaacccatcgccctgcagacctgcgtccgccgcgggctccagaagcccggaggggacgctgcagcggggactgcgacttcgtttagagagtagtagttcattcattcattcattcgacaagcatttgtggcgctctgagtgtaccaggcacggagtgtcacccagggaagcgcggatggtagtgttagtccctgcgagggcggctggtggcgaaaggaggctccaagtgggcagatggaaggagccacccgcggggccatgggtctgcttagtgatctctgcctggaggggaccctgagagccttgtctccctacacagaaggacgctctgcacagagcatggctgtggtgacccccgccttcccccttccccctccccacttcctgaaagttctgattggccccacccctccaggactggctctcctgcagcttgttttaatcactttttgagttaaaagtcaatatttaattaaccaagtaattacattcagctttcgtttgaatctggatatttgctctgtctgtggggatgcccgccctcttccccctttccatctgtccttgcctctttcccacggtgcacccccagctactctggaggtgacagagagcaggtgatgttggctttccctggggacaccctggattttgttcaccttgcagttcatgtgacccggtccagctccttgcccagaggggatcaactgagatacaaccattgattaaaaggggtgggagttccctaaacacccctccccccaagattctccacccagcctggctggtccccagggaaatcaaaacaacctgtttctatgtggttcagtgttgaaatcagcagtttattgaggatagtgttagcttggccaatggcatgatgaacccgctgtccctgccctgggctgagggtagtgtggctttggactttgtgtaaccctcttgagggttttttatttgaatttacaacactttctgaaaccttaatagcatgttaggttttcaggcttaaagtttgctgactcaagactggccccgagggagaaactccaggcacccttgtacagtctgtgtgcctgcgtgggaccccctgtcccacatggccttcattcaaggaccccatcccacagacagtttcactcttgatgttccaaatgccctttcacttgggaatccagcgcctctctgtagtctgggtttggtgctgggtttgacggcttttggcccctgggtatgtggaggattgtcacacagccattatcttttcttagactatgccctctctgaagacctgaggcccttcctgcctttctgaccagttcaaagaaggttccccttcacctcaaagataagaggcaggaagtgtttgagcccggcccttagacataatagtcacgtgtccacacaaaatctgtgatacattcctcacgctccaggtccactctgaaccacggggttgccctttcaccaggtgcttgttttctaaatgcaggggacaagaaacatgactagtaaaatagtaaagctagttaagttagtagcctgtctgaatcctttcccttccccaagaaccgctgctgtcgtgggtaactgtggggcggtgccctggtttgtattgtgtgttgttattgctgttttctctggcttttggggtttttgtttgtttgtttgtttgtttgtttttgttttggggagggtttggttttagttttgggtttttttgtttgtttgtttggttggttggttttggttttggttttggctctttttcccccttctctttcccagggtttcatctcctctcctggtgtatatgtgaaggttctttcaaatgtggccaatgaaaaccatgcaaaaaataaggatttttttagctcttaaaaagcacagggaatgacataggacattgtaggagtgagaccctcttgtggctgctggtggactggcctcagagcgtgtaccagggacttggtttcagactgggctctgtgtgtcagtggacaagaaagcgagcctctccataatgaccatagcaggccaggacaatctggctatggccagccctgggggctggcctggtggggaccccggcagatgcccatgctccagccggcttcaaggcgctatctaattgggagatcattaagatcattataattaattggcatcctgataaatggcgtgattgcctaattggggtggttgctagggaactagacctcacttggagcctagaggggaagaggcagtggctggctgcagttgggcgctggggttacagaccctgcagctcatgggcgggaagccagaactgtatcacccacatctgctggcagctgctgagtgtagttgtagatggaatgtgggctaggggtgttttcttagaagggctgcaatcaggaccctttcttgcaagccattgaaagagacgctctgaaatcactgggaggcaaaggaaaaatgcccgacgccttgcacagggccccaaatcctaagacagccttggcatcgtgcaccactggctcagagactcagcatttgccacagacgccattcttccatctccgctctgccctctacctcactctgtgccttcctcagaactaaagctgcagtctctggcagccccaggctgggtgttttaagacagccggtccatctggccacctgcccagtgatgacatgggggcgtgtgactcaaccgttctgtgcctctgtgttctcatccaacaagtgctgggggtaagtccccactccttcccgagtctgtgggccagagcgagatcatcagtaagtaccaagtgcttagcatctgccccaggtaaacctggaccacagggtggctgctctctcacccctgtggtcacagcccaagaacagaagcaagcctctttgcagtgacagtccctaagcccccagatgccctcccatgagaccactgaccagttacacacgccctctgactatggtctgaatgagaagagaggaccccttggtcccacaagtgtgacaaataagcatggtcatttggggagcaaggagccacgtgtatgggcagccaatcgtcagaagggcctgtcagcaccctggctgaggtgagaactccagggacattaccaccctccccttcccatggggtctttgggaaccagaggctatcttagctgcttcagtggataaagctgcagcctggctttgatccaggcctttctgggggctgagtttacctggctctccaccatgaaaatcatcatgaagtgtttgtttaaaaaatgtaaagtcccacagagagagcaggcaccctgcatatatatgttcacgtcagcaaaaggcttggaaagagggccctgtctactagagggcggtagggaatggtaccctagatgagaacagggggacagaggtaccaaaatgcaccctcgccttgaacatgacaaccttcttggtattgtgaaggtcctattattacacgatcccacatcgggccaataccacaaggggtcaagttccccatgggtcccagtaccataaggatcccagtactccatgggtcccagtacagcacagatcagattacctcttgtcactagtaaatacctgacaagagccaggtgctgcctgagggcctagcccagcaagagagagcctgggccaccagagacacaaggcccccaagagcaagcggtgaatgggggccatagtcaaggcagtttataacaggcttcaaaaaaaaaaaaaaaaacagtaataaaatacaagacaccttcaccagtgcaaagcacggtgaggcatcttcagggaggtggtccagagaggcctccctgaagaagagatctctgagccatggcctgaagtgtaagaaagaggctggcctcagggaaaagacaaggaaagaacacttgaggtggtgagagagcatcctgtgcaaaggccctggggtagagaacacgggttgttcaggaaccagaagtccagtgggagtagggagccatgagtgagtggtggagacaaagacagaagtgtgacattcagactttagattttaaatgacatggacaatccgaggaggctgtcagacaggaaggagcgagcccatctgtttcagaaaacctcggctcacacgatcaataggctcaatgctaagtggggagacaatgcccggggccatcgggaccatgggagtcagaacagtcaggggacaaaatcataatgatggtttgggttggatagaaatttggggtgtggagccaacaggacttgagcgggtccagggttcagaataggaaaaagccattgattctcaaacaagggtgctcttgctggctaggggacatgcagtgttggtgaagacaattttgagtgtcacaaacatggcacccatgggtggagactgtctgtgcctctcaccatctttcccttcgagggagggccccacccaaagagggaacagagtgctgaatgcactggccggtggcctgggatagggtggttcctaagcactgtgaggagggagcaggggggaaggctaagggaggactgagtctggtggttctcgaggcccccggatgcctcgtgtgtcctggatgtgcgagtctgtagcctgctgaggctgaaggcctgaacttgggagctgttgtgcttcccagttattttaagccatgtggctagacacgcttacaagagagagctcatattgtgttggctggtgtggtcccctgtccccagggcctgttacatacctattcggtgaatatttttggacaccccactcactctcctctctgttcctgggagcactagaatgcgctggctgagctttccatgactgactcctcaactcctgggtgattggcagacagaaatccccactgtggcagaggaaacagggtgggggttgcggggggggggggggcatctccaccctgacaggtggcacaatgcctcctgagtagagcagccttctaagcctcctctgcagctgagtctagcactttgctagattctcacagaccagtgttttacatctccagtctcaataggattgcaaaacacacatagaccccgtggcaggggcaccagactcatagctagctgtctgttgtgaaagacatggccccctgctttacacactgggccccactggagacagccctccattccagcccagactcgaatccttaagctaagcacgcctgtggggcctcggggtaggggaagctgaggccataagctgggggacctcaagcagggacataagatgtgtttggccaggtgggcgccagatgtgtctaagaagtacgttgctgacagctcttcttgtgggcccatggctggaactctagcaggagtctgacccacctcggtagccagagaggtggggatctgtgcaaatagcccagggagggaatctgtgcttggtgagccctgcctaactgccggctctagagactcggcatgctgtctggagacttctaaggccagctgctaagttggatgtctcagagaacagggaagccgaccaaggtcgttacgatagctcagagtctaatcaccatgctttctttacttatagtaaaatggaattcttggcttagcgatctgggcaattgaagtttctatttcccaacacaacaaaacattccaagtactggagagcccaagtcttgtcttttgaaaacatcttagaatgatgttttcagttttctgctatccactgtccctctgtccttcttactgtgtctttgaccttcttgttgtctcttgttgtagctgccacagagccaatcatcaaccccccgccccttcaaagtaggatataggtcagaactttttttctcgctcttattttccaaagaacaaaatccttctgaagctcgccctgccgcaggctttgctctgtgcctccttggcccctggctgggtgttgtactggattctaaaccaaatgccaggaaggagggaaggataagcgggttttgctgatagtcttagcgcaatgctttccaaaccaacagatcaaacaccttcgggttttagcaagtgctttgaggggaggtttacctggaagggactcacagataacttatctgcaccgtcatcagtgaaataccccgattaggaatgaaagggaaaactaaggcagagtggcttataattaaacacagtaagcacactgcagcccagcacctgggtggggcacctgggcggggcacctgggagggactggcaaaggtgccctcattgtgccaaggggcacaactctgcaggcagtgcaggtggatatttggccaacatgaccataaacattttctagcagctgaggagactatactgggtggataagccacatgccaagaagccaccaggaccttaactggaattccccaacacctatgtaaagaaagacccaaagtgtggctgtggcacccacaatcccagcacaatggaggcagaatcaggaggaccccgaaagcttgctggccagatagtctagctgaattgttgagctcaaaacaaaacaaaaccaaggtcgaagacaacagctgctgtcagcctctggtctctgagctcacaaacatgcacacatatgccgtgtacccataagacaatggcaattttataaaatactgaacaaatggccaaatttcccaagtgaaatgactcttgctcttcccttagtttgtctgggtgtagggtaaaaacaattccacggtgatcttcttcatgggtagcagtccttttcttggctcttgaagctgtcagcagctttctcctctgcagcaaggtctggcagaagttagttaggaaatcatcctggaactctggtctcctggtgcacacttgtgatccggaggctaaggcaggaaatcatacagagggagtttgaagctagtctgggctacatgagattctgacccccaaaatcaaaatgggcctcccctcagcactgcagtgagtcatatggtgcctcggatgtcctcacacagtcccagggtggcccctcgggcaaggagagactccctgtgagtaacagtttacagcagtgcggatttggagaactggaggcatctgccctaaagatgctgtgacactgagtgcggccagcctttgccacagtcggggccaagtgtctctggttgatcttgggatcattgtcatctcaccaggcttagatggagcaggggtaaaagagacatcctggaggtcacggtgtcacaaaggcaacagctctaatctgaacgccttgctctgctctgcctctcaagagctgtgtgcaggtgggcgagccactctgcacctctgagtcacttttgcctccagtggaaacctggacagccattgcagcctgttccctaagtagctgtggggacccaggtaatgcctgggcacgaggtcccggctacagaaaagctggcttcctatggtcactgttgtagctgtttctgctcgtatctgagaatcctttcttagcttttggggcagggttgactgtgtctttggggcactggctctagggaagggcactgaggcagttgaacacggaccagtgggccagaaaggaaggtatcattggggtttactgctcggccataccgtgtcggctccccacccatcctaccttctcttccaggccccatccacactagcccaggaaggaagccaagctcggggcctagaacctgtcctgacaacccagggtggcacctgtcactgtgaggataggcagatggttggaaaaaggaagtcttagaatctcccagtgccctggccacagcctgatggtaaatcgagcgcctctggagtcacagtccaagccttgaggtgcttcacagctgcctagagaatgccagtgttctgcactcttgggaaccataaaagcaggagagaaggctcaggtatactgcctctgccaagtcccaaaggggctccttgaggtggcacacagcctgaaatagcttatgtcagggcctgttcctgtaataaaatgcaggctcactgcaatatcctgccctgtctgtacccccaccccaccccatttacctctcagactcttgaggctggttgcctgccctcccccactccccatacactggacacttcgctcttcttggatgccgtaaagtgatctccaacactaagtctagatacttgctctttgaactgtctaatgtcacctctggctccctcagtctccgctctaatgtcactctaggatgacaatgtttcctttggaattctcttgtttgttattggaattctcttatttcctctctcctcattaaaatgtcagcctagtgtggtggggccttggtcttctcagagcttggcccagccctgcaggtaccccggaaagaggcctgcagattggctgctgaaaggaacggagtctgtccttgctggaaggtgactgactgctcagaccctggaagtccaaacctgtttgtcgctggcagagaacaagcttaaagtggaactggttagattcacacattcccacagtagctggcagaggaggggtcatcaccctgatgtcccggcagggacagcaggcctcaggaacacggggcgcttgggccatgtgggaagtgaaaagttcacctttgagacaggtgatgtgcctcatctcctccctggcctcccaacatctaagcgcatcacaggatgggctctgagcactgcctgggttccgggggacccaggatgatttagggctggagtagaatcctgctccgtgtattaggggctcatgtctgcagacctgggagtacagagccctgtctagaaaacaaaagaaattgtaaggcctccaaattgactacccagggcctgtgtttggcttttatgttcttcacccatgtgttattttgaaccttttggggggaaaatcaattaatagaatgttggggtggggtgtcccccccaacagggtcttgctatgtagcgcaggctgacctggaactctcaatcctcctgcctttccgtcagcctcccaagtgctagaattacatgcatatttcaaaagttagagtttcagttagagacagtgtgtgccctgacaggccacctgagtgcctcttgacttagccaagggctgcgcctgagtccggccacctctgttcttgccctgcctggttagttttcccacggtagaggcggcctctgcagaaaacaaagccagagtgggggtggggagcagtggccctgtatcaggcccagggggagcagtggccttgtatcaggcccatttctccaatcacaaggcccacacagatgtcagcaccctgcgatgacacgctttcagggacaacacactacacacatgcctgtagtgatactgaaatcttacacctgtcaggtagcacacacctgtaatcccagcactctgggtgtgggggcagtggggtcatgggttcaaggccatccttggctacatagcaagcttgagacttagcctgagctacataagaccctatttcaatactagtgctgctgctgctgctactactactactactaatactaataataaaatctgccctgtatttgttgcttggcatttagtcatccccaaaatctttaaaaacaggaagttggtcgtgtctgtctagtaaggggtaaactgaggcacgatgtggaaagcttcagtggggtcattcattaagatccgtcatcttcccacgtccattgctaggctctgaggtgtgtggtggaggtggcagtagctctcttgtgttctgacaatgcgtgggctgccagtgggttgctttgagtgaccccagtgctggtcacaggcattgtttcctcagccgggctgactcccacatttctgtgtggcctgagcagccacatggcagccggagtgtagcttcaggaggggcagaaatgagaaatgccgagtctaagccttacacaggtcctgcgtcacactggccgttttctctaggataggagaggttgaagaactgcaccgtttcctggggtggaggctgcacacaggtggggctgcccagcagagtctgaggaagtaacaagtcacccacccgtcccaatgcttgccccaggaactggattcgtctgggggcactgaaaggctcagggatctgtaggagagctgggcttgggagagcacaggacacagtctggaagtctggggggtctctgagcaggagttgctagcggccttttggagtgtggcatgagggccactgagagaccattcacccctgctggggcccttgctctgagcactatctgggaggcctgagctcaggaagagtctcattggctagctctggtcacatggtcacccttggtaggagagaatatcctctatgaagtaaattgagttactgttttccaaagaaggaaggggaggcgggtgcttctcaggcaggagaaatgaaaagtctgcatgcgtcacccttcttaccaagatggagcggctatcatctcaaaggatggagtttttttggtttggtttgtttgtttgtttgtttgttgtttttcaagaccgggtttctttgtgtagccctggctgtccaggaactcactttgtagaccaggctggcctggaactcagaaatccgcctgcctctgcctcccaagtgctgggactaaaggcttgcgccaccaccgcccggccaggatagtttttttaaaggccggcagcgacagaccctgtagtgaggtactgggcagagtcaactcccctcatccagctgttcctcagtgttcttgtctggaaaatgaagatgacctgtgtaggtcctcccggcaccccaggtcccggacacacccccaccccagccttgtctggacctgggtttctcggtttcctttcttgcagccccaggatgtgcctacttaaggacgctcaggctgatgcctggcgccctgcagtagcactgccctggctcgtaggatccgcggcctcccttcagatatttactaacccatgaggcacacagggcaggaggtggggcccacatgttctctatccagcccatatatagctgggtaattggtcaaagggacatcaggcatcggtcccacctgtgtgtcccagtctctgggaccagagcactgggttgttaatatcgtctcgggatggagggatggcgcactcagccagtcatcaggcagaagaagaaatgactgggctattaatcccagcagtcaaaacgccctagtgttcctggatggtcttcctgaagaacaacaacatccacagccagaaacaccccccccccagtgctgtgtgtagggcacccatgggcacgggaagtgtggggctgagtgatagggcgagagaggctgggacggtcagtccccactgcacaccagcccgcaattaggcgtgaataacgactctgttcaagttgggctttattgcttttggctccaggccttttacagaaataactgtaactcctgccaaggaagcctctgtcctcagctgagaggaaagaacaaagaacagaggtgggaatgtctgcatctgattctagttccccgaaacacccaggaagggcagcaggcgtggctgcccacaggcatgggctacggtacagctgtgtccactctcggccgtgccagccaagcagctcccgcgtgcttccgccatccaggctctgtgggcttactccgattacggggcctttgcctttattaacattcccatgtggtgtggggtgggggaacttgggtgccacggcgtgcatgcagaagtcaggtgacaactttgtggagttggttcccctaccttcgtgtgtgttccagtgtcagagtccaggttgactgccttctgtagtgagtgcctttgccactgagacatcccgccggccctttcatgcgcctttcctttcctctgcttagaaggcgtttcacgagcattgcctgcctaggatacccaaggcctgagggttagtccccagcaacgggaaagaaggagggagggagggagggagggagggagggagggagggagggagggagggagggagggagggagtttcagttctaaccagcttctcactgaccttttgagtctcagctcaatgtcacttcctcccagaggcctcctctgattgactctctggcattgcccccctgacagattccttcagagctctcagaagagtctgaaactcttcagtagctcattctctgttgttctcgccagagcaccagtgtctggagccagcccttcctcatagtccctgaagcacccacacacagtggctagcacacacacagtaggtgctcaggaaagacctggtggcctggaagatttcctcacagccctccagccaagctgcagaggggcttcactgtctgtgggcttagaatggactggattccctgtggcctgtctcccagatctagttctttgtcctttttaacatttgatttttaattacttgtgtggatatgggggttgtatatgtgaaggcagcgcctgcagaggcattgggtccctcatgagctgcccaatacaggtgctgggaactgaactcaaggcttctgggagagtagtgtgtgctctaaaccactgagccatctttccatcccctaggtccttcgtctgtgcccatgtcccggactatagacaaaggctgctgcaaacaggtatctttttccaaaaatgaccagacagtcctgaaagttcttgcatggcaagccttcctccccaggtcacatcccaccctgtgtgagattttctgagcatctagactcttacaaacgaggaggggagctggcaacaaaaaccatggaaagaaattaatgttttctcgaacttcagatatgaaagctatttctgtctttcccagacctgactaggaaggtttgttgtcaggaaaggctggcaagacagcctggcatcctaccatacctatggcagaggcaggcaggtcaccgctgagtgtacagaggaaattccagaccagacaggaccagacagtgagacccttcctcctctaaaaaacagaaacaagctctaggggtgcagcctattggccgagccctgcccagcatgcacagagccctggggtccatccccagcactgcataagcacaatgtggtggggtgtggctataattctatcactcaggaggtgggaaagggatggtcggaagttcaaggtcacctttggtgagttcaaggcgagcctgggatatgcgagactttacccttaactcacacctgatcccaacccttcttgccctccggatcctgtttatcatggctttcactctactgagtcatacaagaaattagagataggttaccaggtctagagataggttacccagacttccttgggctctgaggaagctctggaatgggcatggggtcagcttatatcccaatagacaggtggctctcactgcccagcaggacagggacactgaggtgacggcctatgagccatcacactgtgtgtgtttgagaagtgccgcggagcctggtgtgttcatctatactgtgtcctctagactctccatggagaggtgaggctcatgtcctctgccctcagactaactcggctacatcacacatatccagagaatgaagggtaagagtgtaaagccattgaagggaaccggcagctcccttgttgctgggcacccagctttggaaccctctcttggccccaccccgagtccaccagaaacaggccgcacgcaagcttgctcagcagtcagcagataacccaagtcacagctctggagccttgccagccatggctacaaacagcagagagcaaccgttcttcctgagtctgacgaaaataagtgagcttgactcacggcccagaaggctcggtggagaaactgaccttaaaaaagagagaacaaggggtgaggtggggtgggctgggctggagagatggctcagtggtgaagagcaatgactgcttttccagaggtcccgagttcaattcccagcaatcacacggtggctcacaaccatctgtaatgggatctgaagccctcttctggtgtgtctgaagacagctccagtgtactcatagaaataaagagagcgagagagcaagagaacaaggtaggcaacagtgatggacacctctgcaggcagaggcaagcagatctctgtgagtttgagaccatcctggtctacagaggaagttccaggacagccagggctgttacatagagaaaccctgtctcgaaaaaacaaaagagaggaggacgggggagggagagaggaggaggaggaggagagagagagggagagagggagagagagagagagagagagagagggagagggagagggagagggagagggagagagagagagagagagagagagagagagagagagagagagaacaactcaaagctgaaggagacagaatctattgagcctgaaaaaatggaaccgaaaagccagccttcttttttcaggcttaactggaacaaggctcctaatgtcattggctcacccacttcccagaactggcctcttccagtgtttgcttccttttccactctgcaggtggcaagatagtgacaagaccctttgttttcgtagaatgggctcctcttcctgaccagtcaggccggtgtacctacgtcctgattagtgagtcactgatgcacggggattgaaggactgcttggctcaggtcttggtctcatggtctaactttagacctctgcagctacacctaaacattctggaccaaaggcagggagacagggatgctcaaatggaagcaaggtgctgatgccgagtagcccagagccagcagatgggacttgacaacattgccgggccttggctgtacttgcggaggttgttagccatcccaccctctcagctctatgcagtggatgtagctacttctcccactttacagatggggatatcgaagccctaagaaatgatacaccatcatatccagtgggcagcagagctggttccagatcacagtgcaccccactctactccatgttccctgctgcctcgccccacacacccaccactgtggactgcctggctcaccaacaccccgcctctgcctgctccatgggagcagggatttgggtgtagttttcactgggcacagcagatgtacaggtgtgtgactgctggggtcccacagcccatcagccatctgcttctttggcacattgacggtctggacactcggcttcccaagattctacatgtgttgtttctagcctctctctgagctccagccgggagcccgggtcttgacgccacctcccatcctgtctgttgtcccctcctggtgatgccactggcttctggtgtgttgactcattagagagtcagtaccacaagggcaggtacttggcctccctctgtttggtcacggtactgagaactgcgcctggctcacaggccttccagaacgttctagagtctccatggttttgcagctggctaccatcttgctggagctctgggaccactgttcactgttttcttcatgcctgagttacctacccagaggctgagccctgtgttgatatcgagcctctacccctccacccccaagcccctcagacgggtcctctcgtccctgtcctgtttcagggctagcttggttctcttgtttctagctggaatcacagaaaaaggcaccagagtgcccaggtcctggaccttagaaggggacatggggacatggggaactgtcccatagaccccagaagctccctgtcaagccaaagagccctcaagggagcctgcacctaggaggcaggagatgtcagggctagccgtctgcctggccacatgttcccctcccattctgcattctttccctcagcctaaggccacaccctctaccatttcttcaagctctccctgagctccagggcttctctggcctttgtatctatctgttgagcacctcaaacttgatacttcccaccctcctccaggcagtcttccctgactgtccctgccagcagtttctctgtattgttcctactcactaaacctcagtcctggctattgttctgggcttctgaatgggggttgcaagaaaagggcctggggtcaggacatctgggtgcacccttgcttacctctcatgagcagaaggcacctacggacagagctgtggctctctgtcaaactgtagagccgtgagctgtgagcttacttcccagagacccgcctccaggggcctccagagcacccctcccttctctccctaccagtccctcctgtgtccccttgacaagctcacccagaggcagatagcactgacgctctgatgtgacctttcctgaggaacctctcgggggacagggagtggatgtggttgcaagcctcattattcatggcagattttgaacccgtcctgcctcagcttcctcacctgtgcctctcagtgctgctgtatgtgtggctacacaggtaacacaggatggacgttgaggaatgcgttgggggttatgctccctcctgaaggacagtcccgactagtctttgattgactacgggataaaccttagtcccacccattattacccaaatcctctctgggctccattcaatccatgagtaacaacactcgcacatacatacatgcacacacaggggggcacagcacccaggacagggcttctgaagtctcccaggctcctagtctctcattggtcagacctgggtcacatgcccacctctgggccagtcactggagccaaagatgagagatgttcattggctctaactgtgtccgtggaccttgctgctgcagccacactgagccacaagtggcctctgggcacagtggagggctgttactaggagacagatgggagaatattctatgctacatcaggaacaaacctgagcacccactggtgttggggacacaggaagggagaaaactcactgacagagatctgtgccttccgggaggtgacattctggcagggagattggcaggtagactaacaagtggctgaggtggccagtgcttcaatctcattgtgcaaagctgagatgtgagcaaagtctgggtggaaggggctgggaagatatcccaatgagtggccagtgcaaaggtcctggggtggagacattccaggcatatacagagagagaatgcaaagaagggttgagtctagggtgagattgtgaagggtcttgtctttgtgccctttggggactctgtggttttaccctgggtggggtagacccttggaggcttttcagtaagaacaggccttggtttttctttagtggaattctggctgcttggtgagagaagtggaacccactaggggttgtgtcacccatcctgggggggtgggggggacactcctgccaccaaataccttacttcatatccaggtggtcccagtctgtggcaggactctgctcgcagctcatggtatctctgtgtaccccagactagtccttcctcggctccgaccccgtcagctgcatggtccttcctgtactctctacccttcttgtgggacttggagacccccagaggaaaacagccattccaggtatcctgaatgagaccctgaggattccccatagctaactccgtgggccaggaatctccagccacaccaagacctgcccccacgtagagtggcacatagatgcagaagtgtagcggtgtcttcacactcttgggactttaggtgtctccagagatactttgcaaggctgtggggagcctttgccaagtccagtgagaagagaaagggctagacaggctttgaaatgagctgatgagggaggcggtgtgcacagtggtggataggatgctctgagacagacagcacccggtccagaggcattctgtgcaacgattttgaatcttcttaccaagaaggagaaagcagaatgtctcctgtcgttgttaattgatttcttctgtgtccagagagaagctggcacagagccagaagtcatcagggtggggcttgggggggactcatcaaaaatcgacccacggatagctcgggctgacagataattagcccctctcatgccacagctctgcgttgcggaactcagcctctatccggggcaggaagggctccttgagaccagcatgcagagccagggctgggattggagcccagcagatgacatctgcctctgccccacccccatccctatcactgtgatagctaaagaggttccgggagggtacctgcccacctgctgccttttggggcaggaaagactgcggctagaatggaagcctcttaagaaccagcttatagacctgcttatgggcttccatcgtgccagccaaatccagtctgggtctgaaccttgcctgcccagaacctacagtcctgggaaagtgattttagcgatccgagtgggcatgacgtcatcactaggcagttctgcgctttagatgggctgatagctgtgaagtgctcagagggagagtcacccagggccttacaagctgggatcgcaggagtgtttgcttacatgagtcctggctgcaaagctgccactggaggccctgaggagcagcctgtgggaattccctcgggactgtcttacttctacttctgggacattcagtgtatctacattggtgcttctggaggggcccttggcctcttgataagtgtacttttggggggatgaccctaatttggagtagttcaggggccagcaccatggtgagggaatctctctgttcatgcgagcctcctgttccctccagactgggtggcagtgtgcattggtttctggcatcggctggtatcctcactcaggagaacagtgtttgaaagggccctcctgcagtgcacagggaggccgccagctttctttagctccatgggagccactctacaccctcacactggggaaaagaggttcccaattcagagtgtgtatttgtttgtttatttatcgtggtggtagatgctgtgactccgacaggcttcaagcttgtaagtctcctgtctcagcttccggagcgctgtgatggcattgttacctcacctgccatttaaaatgtgtctgaagatgtcgtggattaaggtgacgcccagttgtgggcttgcctagcttgtgcctaccctgagtttgatccctggcatagcataagccatggtggtgcacccctgtaatctcagtacccaatagtggaggtgaggtcattcccggctacatggcaagttcaaggccacactgagagcttgtccccaaaacaacagaaaagagtgggttaagcaaggaaagggataggaaggtgacaggaatggggactgtggcgttggattgaagaagttgggggacagagttggggccaggagagacaccaggcagtcaggagggcaaggttcaggtgctccctgtagtcctctctgggtgcctatggggacggtgagtctgtcttcttggctgtcttgggtagatgaggagagcccatagggggtgggagggtcatggaaggggctgtggaaacccctgcaggagggtgatcactgcctccagagagcattcacactgcagtgggaaagctctgctcccacctctgggcgacgtgtttgatctctcatgcccagctgtctgcaggggaaactgaggcacggtggttttaaatgaccagaccaggaactcaaaagtctgtgcttttagctgtcatgcagggtggatcaggggaggccaccacattggctctctgtggtggtagatgagggttttaacatggcaggaggccaaggcggccagtgtcgaccctcaaggacgccaccctcagtgagcaggccaggtttcccttcttagtgtgtcctcagtggcctggtgccatgactcccttcccagatctctgtggagacactgaggcaggcactgggaatcactcacagtctttgccccacaaaacaacccctctcggggtggggtgggggggggagaggcaaatgttcaaggacactctgtcaacctgtcacagcgcctggtttggaactgggtactcaccgtgcagtgggagaggtgaccacagacatagaggacagaaaggctccaccagcaacaaagagggatgcagactctggggccctcagagggcagggcccattgctaccctggagcaagggacaagaggaggaagcaatccacgtggccccagcagacctgtggctacagatggggagctactggggggagggcagggcgaaggaggaaaaatagccgagctctcagatggcttccagaggtggatgcaggctctgctccctgtggagagatcaagagagtgaacagcacccacccagaccgtccctggtgcctctctaatgatgccaccatgatggctgactcctccttgggggcccctctggagaagcatgtgggtgccctaggtctctgagttgtgtagactttaggtacggcatggccctctagaacctagcctccctccctctgcagaattcagagtttcttccaatctccacccctctagttacctagtcatttgcatcaggcactgcccaaggagcaggggacctagctgtgaccaacacaggcctcatctctgcccctcatgggacatcctccatctgccctgaggaaaagaacacccctgggcattttacagccctggggcgagtgacatggtgacaacagcaggccacacaaccccatgggggccctgggtagggctctgaggtggtggctagcatccccttcccatacctccatagtcaacagggcagacagacaccttcaaggtcatagttatggtgatgtgtcctgactcaatggcacatagtcctcccttctccgccccccccaccccccagcgagaggtggctgagccgctgctcggggaccatatcccacctcccttacccacctttgctggagatacagtctgcctgcggtcaaggatgacagagagaggctagcgtggaatgctctctctgtagtcatcttgtttactccgcaaggtcaatctgatgggaacccttgtgcccaactgtggtatcaggggatgagggccatccatccacggccttgttaaaagtaattagcttggccatggggaaactggggttctcctgatgtttgtgaggacaacaacccccaaggggtgggtctgagccaagaacctgtgaacatacagcccaaagcacccaggaacccaagccttctgctgctggagctggaagggaaggggcaagcaggggtgctggtggcttgtcctttgctgtgtctgggtaggtgggtacacagagctcttgtctgttaagggtttctttactatgcttcagggcagttcctgtgaacagttctgctgccaatctgcccctgagacaatttctctagcttagccggccctgtgttcatgccatcttagacagcggggaaggctcttcttgcccacactgagccttccttgtgtgaggcagcatgcaagcccagcggggcaactgtggtgtcagtactaactctcacctacccctctcatccttcagatcctgagggaagaggggaaggaatcccatcctcacgacaccacctcggcctctgcatccaggaagaagcaaaggaccagcaagccacgccaatggcaccccctggcctgccactatggctgctgtccaccgctctcctctccctgctggctggcagctcggccttcctctcccatccccgcctgaagggacgcttccagagggaccgcaggaacatccggcccaacatcatcttggtgcttacggatgaccaggatgtggagctgggtaagtggctgagctagccggggacacctggggctctagaagaaccatgtccccacacccccatagaaactccaggtgccaggcagttgtgtggagtttgcatctgagttcacacttgggggccttgagaatgtgggttcgtggtgaccctcaagggtagggatctccatcttcccaatgcagactgattccccaatgcctacaacctaaggagcagagagactgtgctcagtttgctcttgtcaaccatttgctctcccaagccactgggccatggccttggctgacagctaagccatcccctgtcccttcccatctgagcaatgccacggcttttgctctttctgctacaagaagcactggtaggagacgccaaaacggaggccaccaaaagaggcttcaagagtcaatctaatgcccggcgtggtggcgaatgcctttaatcccagcactcgggaggcagaggcaggcagatttctgagtttgaggccagcctggtctacaaagtgagttccaggacagccaggactgcagagaaaccctgtctcgagaaaaaaaaaaaaaaaaagaatcaatctagatctgttctggatcacctgtgggcatctcccagtgagccccatctctccctctccgtgtcttctcaccttgaagtcaacgtatgggttcctccccagctgagcccctcgtccttgctgccccatgggaacactcgaccctctgtatcctcagttctccatttgcagattcaaccaaacacagatcaaaaccaaagagtacggatgggcattcccactaatcattagtccctgagcagtaccgtaagacctagctccctgtgtcacggtcatctagagcgaataagggggatacaggctattagcaaagagcacggcagttaatacgggagcctgaacatcatcagggcctgattccccagcaccgagggacaactgtgcaatctgagccacaaatgcaagtgactagagatgtggcttagttggtagagcacttgcctggcatttgcaaagccctgcattctgtctccacccagcactataaacaccaggcgacatggaagtgtgagcccagcactagggaggtggaggcaaacagatcaaaagtacctgactacgcagctagtgggaggccagcctgggctacatgagatccagaaattaaaaaaaaaaaaatgtaaaatgaaatgagtgcggtaatattttgtttaacccaatatgcaatcacctgaagcgtggtcagcagcgtggattccttaagaatgctttgccttcccttcccttgcccccaagagctggcatgccgtatcccaggctgcacagccacatggagcttgggaccttcatacggcacagtgtgcacggtaatgcagcttccttctgcaagttaggtgcccctcctaatcatctctcctactgtgcactgtgaaaatctggaagcgggtgtcccaggtaggggagaagagaatgtgcaaaggccctggggcaggatcaaagaagtagatatggctggagcctggaaagggaggtaaaacggagaccagcgaaggatggggttgtggttgttattcctgaccaggtggacgctgttgaccaggtgaggggtgggccctttcctgtctgctctctgaggacaatggaatatagttggtggcaatgacagagtgacttacagggcagatctttgcaacttgagtctatgctttaactacccaaaagccagccttgacccagtgggtactgatgaccccaagctcagggaattctaagtacagaaacaatggcccagaagcaggcagggctcagagctttatcgacagcttgacatgcagggtgctgatctgctcatggggaaggagggatctgtggggagtctgcattgtgtggcctaggaacacgggtgatttgtatgcagcagggcctggcctctgggcccttgggctcccttcctgtgactgccaagctgttggctctggtggtcaggacacccaaaacagcccacatggctccacggtccagcagcaaagtttaatgagaatagtaggtgtttgttctgccaggtgctgggggctgctggcagggtggggtgggggatactgtgctggcaaagggatacaatattgataaaccacgagccatgtggccccagtgaaggggcagagggatattgggttgggatttttgttgttgtcgtcgtctttggttttgttttgaaataaggtcttgctatagagcagaggttggcctcgaactcaagatcctccttcctcagccacttgagtgttagggagacaggcatgagccgccacatgcaccttcagtgtcattcttagtgaaacaggtcaggagggagtgtgtggcctcacttgagttcccgagggaccccactgctatgctgatgacatcagggacaagagcaggagcagagggtcgagatgtgtaaggatgaaggctcagagcaagctgtgtatacctggatgcacggatgcaggacctgacccagcatcaactacatgctgactttcaggacaatgcccttgctaagcccgaatcgcatcacaacattgaagctgactcttatcaaaaccagtgtaagcaaacaaatcaggaacccatggatgaaataaagaggggagagagaatgaaccatggctgactgtaagtagatacattcatccctctctccatcttaccaatggagaaagtgaggcacagaggtgttaaactacatgtccaggttgaaacaggatttgaacctagaaccatgaccttcgtcactgctgtgctcagcccatttctgggatggatgatggcctatctagagagtgtccatgttgatgcttcactgtcgcaagtactgtcatcagcagaatctgcatatgtgcgtcattgctcacgagagtgagtattctgaaatgtaaatttcagggagccagtcattcgagacaaggacttgcatattctgtgctgtgacagctcctgcccacatccctgggtgacagagattggtgcccaccaaccgttacctcctcgagtgtcttgttgtgtcctaagcaaacaaaactgagcctctgtgaggagggtgggacgggaagtaggtagttgggggcctgactggctttttataaaccagacagacccagatcaataatgcatgcgcccaaaaagcccggcacattatctcacagttggccaccactggcaaaccgagggtggtcctgaaaaattcatcggctgctattttctgcttgtctgtgaggcagctccagagggcctctggctggaggcctctcaacagagctaatcttgggtttccttccagtcccaggtggggacagctgtccacactcatcaggacccagtgagaagggctcaatctatctcatggttgttggttgtggtcgtcttgccttttcgttgcacctgcagttccctggttgtcatttggaatcgttgggtgctgggttcccagagcactagtgactgagcacctgggttgtctgtccacttgcagagagtgaggacatctctaaaaatacacaggaacactagcagaacagcagcatgggcttatgtgtgacaccacagtcctgtcacaacgctgcgctgtgcccagggaagccaaggaaatgctgggttctgccagcactgaccaagttaagtggatgcaggccaacttcagggcatctccagagctcagctggcttctgagagagcccagggagagtcacacatagcctggagcagatctattagataggattgttccatcataagtgttaaaggtcagctatgtggcactgtcagatgggccattaaggtggtgtggggacaggtatctcatcagctatgacagctcatgaatgaacccaggcatggttgtatatgtctgtcaccccagcactcaggaggtagaggcaagaggatcacaagttccaggccaacctggaagataatgagactgtctcaaaaagaaaacaaaatcagacaagcataggtctcgcctctcctggttacaagtgacttcttgtaactcagcccaagcaatgctggatgaactggaaccagcaacttactggggattgaaatgagaagttcaagcgtacttggagtttcaggtgcgtttagatccttctgctcaccggggaccaagcccgagtccgcatccgaccaagaggcaccatcccagcttccgtgtgtctcgccgtccccgggtctgtctctctgtctctccatcctcgcttcaggccggggcccagcccgagagacattggcccggcccgtgcatcctccctgcctaccccgctgtctctgtctccctccctctgtcccaaggcctcctccagatgtcaccggtctctgtgtgacctcatctctaccttcttccaagctggctctgccttcagacagcttgctaagcacttctgtataaaggccagtgcagccagcagggccattagacagcccagaaatctctagcctgggattgaggtgagctgggcaggtttccctcaagggaaactggacattggctctggaggacacaagcagccgggactgttaagttagggggtgttcagcgtttccccacacatctgctgcaggatgatgaaccatgcgaccctcacttgctccgtcatcctcattcactgagcacttgttcttagagaagggtaactagcaacaaagtaacaaactagacagaatcttgactgatgtgcaaagagcaacaaagtaacagaatctttactgcagcgctgggcgtctagcacagctgtgtgtcaataaccaagacaaaacacacaaactaaaagctgggcagtggcggtccacacctgtaatcccagcacttgcagacggaggcaggaagatctctgcgttccgagatagcctgggctacagagtcacttctaggaccgcctgagctacacagagaaaccctgtctcggaaaatcaaaacaagaagaaggaggaggaggagaggaaaaaaaaaactgcatatgacagggaaggtggtgagaaaggatcagaagtcaagcaaagagggaagggagttgtgggggtggggaggtcgtgtgaaactttatccataatgatctcattgataaaggggacacaggatcaagaaaggccagggaacttattaacaggaattctaggaagcacattcaagcagcagtaatagttggtgcaaagggccagaggcatgcaggctgacagagtggcagcactgtgacccagggcacagaaaatgggaagtctgaggcgtgctgatggtgatgttcatcatgtgagggcttgaggctgaaccagggagaggacttgactttctggggagggtggatgtcaggcatacatgggtcagagaagggaaacagtctgacttccatttcactaggtggagaagaggctgactgtacagtgaggcaggtgcggagtctacagctgtccaggcacaagaggagcccagccagtgctctattgcagtggtgcaggctcagaggcaaagctggaaagatgggcagataggtcacaagtaagacctgtggagaacatctccagggactgcaaagctgtgggggaaaggtgatggggttgctcagtgcccccaagggaggagccactccacagacagccatggtggagtctgaagctgagggtgagccttgatttctgaggttcaggcatgtagtggggacagtgggacaaggtacagctcctaggctttgtgcaccttactgggtacacttactggacactgaggccttcaggaccccagctctgacgtccacatcctgcgcaaagcagacccgggaaaggagaacccggcagccccattttccacgttccatctggcagatgaggagactacactcccctgctgaccggtaaccaagggatgggttggaaaccctcggctctcacgggggccagatggcaggcagctagggagatgcacccagattccaggcagcagttcagggcagcttcatccaccgacatccattctgaacattccagctgccactcaccagcgaaatgaaggcgtgtggatgcaggttatctcaggagtggcccatcctgggttcaaactgccaagtgcattcctgcgagggttttctagttttattcgtcgacaagggtgttgaggggcaggttcgtctgaattctagaaagtgtgtcagaattaggcttggctgcttgggaaaatgaaacctagcattgcttcttcgacacataaaaatgtctggggccggtggtccagaattggagtggtagtgtcaagatgtctctagctttctactctgtcatcccttctgtgtcacatctgtcctcgaggccaccttgtgcttcagaactgccacgtacttggcaacaggaagcaaaggtcaaagggcaaaaaagggataaaacagtaaatgaagagcagcccctgaggaccacgccccagcagtcacgtgggatgtgggcattcttacatagtcacgtgatcttgggtttggccaagtcacagagggtttagcgtctttgctaggggtgaacgggcttgaagaaagcatacagggaggctgctgtgccctcaggttagttactggaacccggatgcagagccacccgacactgtcataccctctgcccacacacagagaggaaggagggggaattcagatacaagcctcaatttccttctctgatcttctgccaggacctcctgtgagccaaaaccagtgggtgcaggagtttgttggtgctggccactctctgaggataagggtgctgaggtcaaatgtgattgctggtgtcatacttactagtcacaagagggtcggttgtgggctaggtgcactgtgagacagaagcgggacccactgagaaggaagcaagggaagcaggtgttggtgggcagaaaaggataaaacagccacaacagggtacacaagggacctggtggggacaggacctctagcactgagtggtgtggtgggatctgtgctctgggggcagggcggcagatgcagagccctgtagtaggcacagtctcttcaggatcttggagatgtcgcccaggctcaggaagaagggtagatggcagggagatgtagggacccaggcgagcctaactgtgagtagggaggggctggcttgaggatgagggtgtgaggcagggagaccagctggggatgggggcgggggggggggggggctggtgctcctgagcaggcagctgagggagaacagcagtggaccccagctctccaactgggtaggcagtgcattgtgccaggcagatggtgcagaaccaatcacagtgtcttagctaggcttatctctcactgtgctaataaaacactatgaccgaacccaacttggagaggggaaagtttacctcatcttacagtttgtagttcatcatccctgggagctggggcaggaactggagcagaggtcatggagaaccacacttactggcttgttcccatggcttgcccagcctggagccttataggaatcaggaccaccacctaagaatggtaccacccacagcgggctgggccctcccatattaatcatcaatcaataaaatgccccacaggcttgcctacaggccaatctggtgagggcactttctcaattgatgtaccatctttccaattaaccccaacttgtgtcagttgacaaaaaaaccagccagccacagataggatgcaggctttgctttgcaggtgtctcttttagtgactgggtaactggctctgtgacattccccaaaacctgggccaacaccaacaatccctatgtccttaaatacttacctggtgtggcaagattgctgtgtgtgcaatcttgagcaggccctccctcagagagtggggaccaatcgttcagagttccccctttgataccctgccactgagagagaacattgggcttttctcccagaagcctccacagcagagccaacagatgacaaaggagagatcgacagaatacctgtgaagtttcatcccagaattcagcagctgagtttagtgtggcctcctggcatctctctgcctgattgacttgggggtttgtagcaccagcttgactttggagttccccagagtgagaagggttccccttgacaccatcaaccaggaaaccatacctgagatcttgcaatattcacctggcctctgagaacctggagctgacagcatctagtgcaccatgaacctctcagctcttgcccagatgttgcttctggctgccgctgctttaaccacccccaccaccaccccccaggcctccctctcactccctgccagggacagagctattctgaaacatctcatctcccaaagtgactgttaagcagatgtttctccggtaacgtggcctataggagggtcccctttcaatgtagacattctggagacactcaacactaggtgagggctgccacgtgaccatcacaagcaatgtgacctcaggatggagggcttcttgctcttggcctgagcttatggcctcttgtcccatctgcatactggggtctttgactgctgcagaatggtccctcctgcatctgcttattggtacctttcggcagaagtagaaccagtcaggcggtaggtgcatgctctggtctttctatccgctgccagccctgttccaggccatggctgcacagggaatgtcgggtgggtggctgggtggtcctgggggaggggggtctatcagttcccatgggcccatcaagaaagttagccattcattcaattttctcaccactccagcagtgtctcctggctgaggtggtgctgggttttgaacatgctgggctcagtgctccatcactacaccacatcgctagctctgcattggtcgattggttggcttggttttgaaacaaagtctcgtgaacttgccgtgcaactaaggatggctgaactcctgatcttcctacctccacccccatcacgaacactcctaacaccaccaccacaaccactaccggcaccaccctcacacattcgagcacacacacacacacacacacacacacacacacacgcatatgcacatacacacacacacacacaatcgccgagattacaggcacatgtcaccacctctgtcttttttatgtggtactgggaatggagctcagatcctcacgctggcgtggctggcgctttacccactgagccaccacggcagcccctggaaccctgatcaactcactgtagtcctcttcatgattggaaggaaacatttccagttaagggtattaatgtattcaccttcattcccacatggccgcccagccacagtgcttagcacttgttacagaggcaagagcccacagtgtccaaaagtcaagtgctctagaagcctctatgacatcccaggaaaacgtcctgtttttccaaataccggttgggagccaggttcctctgacactaagaagacatgactaagactctggtggtctgactgtggccttcaactgtgactgccctgtgttattcacaagcgcctccgtctccacagagaggcctgggtccttgcccaaaggctctcactggaacagcctgtgctgggttatctgtgcctaagataaaagcagagagggaaggccatgggcattcccaggaggccaggggccacacccactgacagcctgtgtgctcagtcctctgaaacagctcttggaaactttgaaggaactcaaagcgaagataacccttcctcccgagtcatggagataagtgaaggatacagtgatcttcaggccacccagcaggagcctccaaggagatactgtttggaaaaacctgaatgttatgaaggttggagctatggcagctggtcctgagacagggacgtgcctggcacgtttccactgtggctagaaggctagcccaagagggaaaggtgggattatcaggacaatactttccaggtcctttacggttctatcagccaaaggtggatgccttagttaccgtttctatcactgcaacaaaacaccaagactgaaaagcaagctggggggaaagggtttattcagcttacactttcacattgttgttcatcaccaaaagaagtcaggacaggaacctggtggcaggagctgatgcagaggccatggggtggtgctgctcctcatggcttgctcagcctgctttcttatagaactcaggaccaccagcccagggatggctccacccacagtgacctccccccccccccacacacacacactgatcactcattgagaaaatgcctgacagctcgatctcatggaggcatttcctcagctgaggcgccttcctctctgcctctagcttgtgccaagttgatgcaaaaccagccagtacagtggactttgccttttgctctgggtgaagcaggtgttcagggagagtgccagaaggattgtgacgacattgcttaatttgttagaaattgctctccgtctgtggagggaagagcagcacagaaggtgacgtaagcgtctactgcagtagtccaggcaagagctggggtgctcacatgcagattagcgtcaagactctgaggttactaactcgggttgtgtttgtcccccataacaatctacctcccaccactttcccaaggaggccccaccctcaaagactctgtttccccacaatgtaaaacaagcaagcataggccggcatcgtcttagatacctgtccaaagagcctcgggagtcgattgcacggaggtggtgtacaccccaccccaaccctgggtagcaagtctctggagaagggatcagtcaagagttgcttcagcaccaaggatggcaaaagtcgttcatgttttcaatcctcagagcccctgggctggaaagatggctcagttgttaaaagtgctcatagcacaggcctgaagacccgagctccatccccaatgcccacagaaaagccaggaagtgctggagaggcagaggcccactggccccctagtcttctcacactggcaagccctgggttccatcagagaccccatctcaaaggacaagttaggaagcagctaaggacacccaaatgtaagctgatggctttcctatacaggtagacccacctgtacgcatatccacatgtgtataaaaggaaggaagtcattctgcagtatctgctaagtccccgtagatggctggtgcctactcaggtctttacaggagcaaatgaaactggggctcggtgcagatttcttgtctagaatgttcaaaggcccgcgttcaatcaactactctgtaaaaataaacacaagctaattcagcatggtggtgccagagacagacaatctcacatgctagatcaacaaacacagacttttagtgtgtgtgtgtgtgtgtgtgtgtgtgtgtgtgtgtgtgtgtgtgtgcgcgcgcgcacgcgaacttgcttcatagctgagggtggtatttgatcctcctgcctccgcctctcaatgctgagattacaggcagatgcccagaggacaaacagggcttttccaatgcttagtactccaccgacggatctccagcccagcccagtagtaaacctcggctctactgcctgcaaattcattgtacaatgcatcaaaaaataggcagtgagagtgttccataatgttacttccgtggatcagagagtgaagggtttcatcagataaaggcccacccagccagccagccagggagatagctcagttggtcaagtacctaccatacagcatgggggtggaacctcagatccccaacacccgagtgaaaaatgcgtatgtggcacacttatgcctacctgtaaccctggttcaggaggagggaattgggggaggggagcagagacaacagactctgcattgctcagtggtcatcagttttggccagtcagtgggctctgagttcaatgaaaggtccagtctgaaatggtaaggtggggagcaattgaaggaaacaccagccattcatctcaggcttccacatgcctaagtgcccacacatgcatgcgtacacacacacacacgtgcacacacacatacacacacaaatcacacaagtagtgtgctaagcacccctatgtagaattcacaagaagaatgagcagttagtgattgtagggatatttgacagtcagggggttggggtcctgaagtttaagtcccactgtgaaggaggggagactgcccatcagaatcacaccaagagatgtcaggctaacctcaccctggccctgtgttgtggcaaggtttggtcaaggaagaaaccaagcctgtttttgtctatatgtccccagatttgtgttggacgacctaagtttgggttggctggccgcttcacaggaaacatgaaagctggcccctttccctgtgtgtggctatgtcttcctggccaagggccattagtcctgggagcccttaggttgtgtgttttcacattacagaagtgggttctacagcctgatgttggggccttttcaataaagtagatcactgtctgcaaaggaggcacaatgttcagtgcttttccatgcaaccccagctgtcattctttccccagaaccatactcctgagacttgcctgccgtagctcttccccagtaggagctgccaggcagggagagggcatggtgctgccaagagaaaagatggaaccctgagctttcagccccaaaacataagagacggccccaaagcctatcggttttccatcaatgaagatttctggggttctttcctgagcttccagaaggggtctgatggttaatggaaccagctcgggtccccagaggctgggcacctgcagacagctgttctgttctctctctggaggtctgtgaaccatggagggcctcttccacccatagcacaagggatccatgtaaggaaaataatggaggagaaaaatactatgaggtgggccccagagcagcagaactacagacgggggcaggtaggatggatggagggagggtgggagacagccacgtagggctacaagcccaaaccaaggaagatagatgtatggaacagtgggccagggaagagaacacatagccaggatggtgcctctgggaacctttggaagagctggtgtgtgtgtgtgtgtgtgtgctgcatgggtgctgggaaccatattcacacagagagaaaagcgggactggggttgttagtgagtttgaggacaaagtggaggtcctgtggctgtgtaatggttagaggggtgttacagtgggagggtgctgactacacccctgggtgtgtcacccaagtgagaaatagacctagcccttgggagaggagctattgcctgcccaaaaggagttggcaaggtctgatggtctatgaatgcagaaagcagtggactggctcaccggatggtacagcatttcaaatgccggccccaggaatagccaggcgttgtctgaatagctgaagggaagagaagcttgactctgatgtggcccaccaggtatcagtagagaggcaggtggcatcaagggtggaaaattctggcttgcatcatggtgtttgccagactctaggattctgtcccctccccagttctaatcacaaccccactcctaacaccaccagacagaaccacactatagtaaccggtccttcctacccccaggagaagctgacacttgcttcaagtagaggaagccagttaggatcaccggccctcaccactccatgaactgtccctgtgtgtgaacaggcatggacatcacattcccctggagccacccaaaggggcacctctgggaattggaggcacctcacagcaccccatcaatgtcataataagagaatacgtctgagctgggcgtggtggcgcacgcctttaatcccagcacttgggaggcagaggcaggcagatttctgagttcgaggccagcctggtctacacagtgagttccaggacacccagggctatacagagaaactctgtctcaaaaaacaaaaaaaaaaacaaaaaaagagaatacgtctgtccccaaggggcccaagagtcattcaaaggcacagggatgctcagcttccccaggacaccatcaccaggccttggtgaaggtgacagtcactgccctgcttctgctgtggataagcctgggtctgagctcttcatctgccaccttccccactgtgtggccccatccatcaccaagtgccccagccgcgcttcccattcagaaaaggacacttggaaaaataactttgcatgtcgtgtatatagagcaattgacccacgtgttagtaattagaacaattgtgagcattgctctccaccccagggacaacccagtggtcccaaagctcagaccaattagcgggctgtaacacagagacttccaggcagggcctgttggatacatgtgatctaggaggtaacgctgacatccactgcagactatgctgtggtatggtgctcagcaaacctcagagaacccaatatgttcaagctaaaagtcagagcttaaaaccttaccatgcaccgagcgtggcggctcacgcctttaatcccagcactcaggagttcgaggccagcctgacttggctggatatagtggcagtcaaggatgaaccctcaatgcttggtgtgggtaaagggcctatcacagtcatttagggggatcagaagcccaggagctgaaggtccagcatatggagggtcctgaagctgtttatatacagctctgttttttatgtccaggagctctgtttatgtacaaaacatggtttgaatctagactcaaggtacttcaaagtaggtttgtacccagtacaactgtctagggggactgagaccagggcctttctggttgggttggcttgggagcagggtctggcccatgcaagcccatggatttcctaaggatctggggagtccaggagatggagagcccaggatataaagggtctaggagctaaagaggcacaagagctggaagtccaggagctcttaggcagataggttagctttaagggtagcgagatatagacttcaaatgcatacaggaggcaccctagatgaggctacaagtgtagagagactggctggggcttggctagactagacttcagttcagtggataattcttgggaaacttctaaacaaaacgaaacctaattctatctgcatttgtgactgctttaaaaaaatctgtgtatattagcactctgaagaaaagacaccctgtttatgtacaaaatagggtttgagtcagactcaaggtacttcaaagcaggtttgtacccaacgccactgtctagtggcactgagaccagggccttcctggttgggttgtgggtgaggagtatggcccatgtaaacccttggatttcctaagcttgcccacagttccaggctcaggattggaagccccttaaagagctcccccgcccccccccaagcaggccacatgactcaccagtaccctctgcttgcaggctccatgcaagtgatgaacaagacaaggcgtatcatggagcagggcggggcgcacttcatcaatgccttcgtgactacaccaatgtgctgtccgtctcgctcctccattctcaccggcaagtacgtccacaaccacaacacctacaccaacaatgagaattgttcctcgccctcctggcaggcccagcacgagagccgcaccttcgccgtgtatctcaacagcacaggctaccggacaggtgaggaccagagtagggcactgttggggcctgctcaagggacagacaggtggcctcttgtgccctcagcttccctgggtgcgacgtccacactgcactggtccccaagataactctgggttatgcccagaaaaggtttcacttcccagtgaggtttccagtttatttctatgcacacatagtagatgtgtctgaagaaggttcagaaaaccaccttttcaaagaaactagagttttaaaaaaatggagagtccagggagattgtgaattctctgacagggaggtcacgagatattccttgcatgcatgagtttgaggtttctgtgtttaaaactgatttattgactgagaccatctgcatgagagaaggttccagaatgttgaggttggaattagagaacggacagacatgggggactcaccagtttattgtgggagtaaccaagatgacgaaggggttgccatggtgagagagacctttgactgtgctgttatttgtgtcaggatgtccttgttgcctacttgagggagacactgtggcgagttcgaaaggccgcccgctaggctggcacctaaggtcaagctgtaatcccagcccagccacctcgcccttgccaaatcctccagactcaactcattgaacttgcttgagtttgaaagaaaaaaaacaagaattccccaccttggcgagcagcctggggctgttgtgaaaccagatgatatggctcaggctcagatgtcgcaagcccgtgacgctacattgttttgagtgggagtgaggaagggccgggcacctcctgtagctgatctgcagccatcatccatcagggctgggcaggctttcagatgcccagtgggagtgggtgggactgtgtactccctacatgctcctcccaccacaggatcatccccagaacaggttcagctataaaaaccagctcccctacatgggcaggtcatcatgggagtggaggtgcagaccccgatggcttggggtccccacagaaagcgcgtgttagaggtctcgtaggccagtgcttcagatggttgggaagcctggaacgctgttggggtggggataggcagggacatagcaaggcggcggctcctattggagggtgcagctgccattcagggctagaaactccatctttaaaaactgaatactgtgggccaaagatgtatctatgggccggtatggctcaagcaccctgaacagctctggctggaatgtttatatgaaaacagatgaataggggctggagagatggctcagtggttaagagcaccgtctgctcttccagaggtcctgagttcaattcccagcaaccacatggtggctcacaaccacctgtaataggatctgatgccctcttctggtgtgtctgaagacagcgacagtgtatgcacatacataaaataataaatccttcaaaaaaaaaaaagaaattgtttaaaaaaaaaaaaaaaaagaaaacagatgaatagtgaggcccccaaagtgttcatcaggcctgtcacctggaaagcagaaagaccactcctcccacaaagactcctgggagaaacatgaaatggaaagtttgtgtggcataatcaaaacagaaaacagaggccacgggaacgcagagacatggggacagtccgtcaaacaaaaggggaaattactaatcccaaaaacactatgggatttatgatggagcgaaagcccatatcagagtcacatgggaaacagaaagaaaggaatgaccatcaaagtagacagtcaccaaaccaggtgcgccatccagctgctggggaggctgatgcaggaaggtcataattcagggttactggggctaagcagtgacactgcatctcaaaatgaaacatccaacgtggactgaggatgtagctcagtgatgatacttgtatggcgtatgttcattttttacggtacaagccccagggacaaatcagtactccagcctggttgtcggtcaaaccctatatccatttgagcatctaaggaaggtaactgagctgagtttaagtctggcagagggaatgggggtacctgctgcttatggctctcatctaaattcattgctgtcttggtggccttgatccaagagcaggtctacagatcaggttctcgtttctccttacttcccatcggtgagaaacaagatatgtgagtgtgagcactcgtggctgcaaaagagcctgggatatgtagtctttacgctgggtaggtctttgtaccactgaaaacagatcctgaagggggagaccctcagtcacagccacagctcttaactgttcgtgtttgtgacgcccttgaatccagaaggtcagctgagcttaaaggacagatgccaaaattcacagtgcagggggatgttaacagagccggtttaaaaaaatgaagctacagctgggcttagtagtacaagcctgtaatcccagttcccaggatggagtccagagggtcaggagttcaaggtcaacctctgctatatatttagtttgaggatagccagaaagggaggaagaaagggaggggtggagggagatggggtaggagagaaaagaaaagaaagctacctggcctgatactgcatccctgcatttcccaacactaagggattcaaaaacaaaaatggaacaaaaatcgggatgggagagattgcacagcaggtgagagcactggcttttcttctagggactgaggttcagttccctgcacccacgtgtcggctgacaaccacctgtaactccagttctggggcatctaacaccttcttctgacctcctcaagccccatgcacacggatggtacacattcacacatgtgagcagagcactcatatatgttacgtgattaattcatattcatgggagaagaaaatacaaaacacattttgaaaataacttactttctgagacagagcctgcgtagtcttcccccaagtcgttgagtgtctagggctggtctggatcttttgatccatctgcctccacctcccaaatgctgaggtgacaggggtgagtccccatgcctggtttatctgctgctggaacccagggctttctgcatgccccagggcactttagcaactgtgtcccagctgcagctgcagccccagccctagatgtaacaaagctttggctctaactgcaatgggttgacgtttgaagtgcataaactgtgcagtccctgttgagaagagtgtaatttgtgccacaatcatcagattggtgtaacatgatgtcccttcccattggcgtcctccttttacagggatctgaggatggcagggggtgcaggaggtgtctttccaaagactccctctggccctgttgacagtcaagtctccactgggttgtgtgtgttaccttgcaatcctgtgtgacagacatgcttcactgagcccagacaccgacttactctctgtcccgggcccgtgtcttctgatgccacttcagttaccttgcatcccgcctctcttaaaagatgactattcagtcatctcacactgcgactgcacagcccgtgtctgcgagggacacacaagagcaaaagccagaggtgctgggtttcagtcgaataaatacccattggttagtggaagtttctggatatggctcccgtccaatccgagactggtgtgtctccctgccccctcaacccaggtgagccaccagcagccctagctgcgctgacagagagagcgcatgcgtgttcccagcgcccgattccctgacaagacacagtgggctgtgggggagttggagtgccagtctgatttccaaacactcctccctgggggggtaaagagccttttccagcactttctaccaattagatgccagctaaggccttctctctccaccaccagagtccaaccccacgtggttacgtgcctgccaggcttccgtagagatggtagtgccccttctgcacgccgcctacatgttctggaatgttcctggggagctgagaacaggcctttcgttagaagttcaggctctgccaggactcccctgggggtgctgtttttagactgtaccatgcaccccactttctttccgttcctctcacatagctgggaaaggacactggctgatgacttagattctggtcattcactgcctgtggccaccacacggtagccttggtgtcctgatacctgcagaggccctcacatggccaggcctggcactgggcaccctgacagtcgctgctactgaaggaaggcattgtgtgcatgtgtgtgtgcatatgacttgttttgcgtcatgaggatgcctcccgtattaccttcccccagtgaccacccctctctcctacctcctgtcctgccatgagcccctttagaccatgtccagctgcccaccgacatctctcttagggtccccatgtgtcaaacctaccatgtccagtatgacctcttcattttgtcacccccttcctagggctgtgcacaggctcccccatggcacttccaactttccattcactcaggccaagcccgtgaaaccgtgtttgacatgtttcccttcctatcacaagcagtccatcaacagaccccatcattcttcctgaagtatccgctgagtccctccattgtcttcctgtcggcccgctcccccacagcacccccctccgccaaccagccgctctgttcccaccctaatcctcaaggtccgcccttccccatcccccacccccacagcaaacattgccatcccatcagaacccctgctgctcttcagcatatgccccacccactagggatggagacccgccctcaaagctgacacagggtccccaggagctgtcccacttgtccagcttctcttggcctcctctgtccctgttagctgtccctgctagccactccacccacagggattccttcctgttgctccaacagtgggcctggcacacgcctccgggccttggctcctcccttcctctaaagcagcgattctcaacctgtgggtcgtgacccctctgggaggggacacctaagaccatcataaaacacagtaacattatgatttataacagcaataaaatcacatctatggggtagtagtgacaatatttttatggttggggggtcaccaccataaaaaagggtcactgcattaggaaggttgagaaccacagctctgcataatcttcaaaactcatgcaatgcttgcacgtatttcctcagatctgtgttcctgtgtcccctcctcagtggaccctctgtgaacaccccagtaccccatcttcttactcattttcttttccttcaaagcctgacaccacccagcaggatctgtctgtttattctgcagtcccttgggttgttagccttccctggcctgtctgtgctccctgccttccccggcctgtgctccctgccctgattcttgcttcctctaacccttgttctggccctttctcccacatggcttcttgactgtctggcttctaaactgccaagtccctcctgcgtctcccaggcccaagacagcctggcccacagtagatgcttgaataggttcacacagcctggcccacagtaggtgcttggttgggttcacacagcctggcccacagtaggtgcttggttgggttcacacagcctggcccacagtaggtgcttggttgggttcacacagcttggcccacagtaggtccttggttgggttcacacagcttggcccacagtaggtgcttggatgggttcacacatcagcccccatcacttcctctcccggcatgggctgcttctccgttatctctctgcttacacaggggagactccggctgtcctggatgcttttctggaccctggtgcagctgtccccaccttcacaatggcagccttctctgcccttggccttcctcctgcctgtctgctgccggcttcctttccccggagtgcacacagggacacacttgagtgtgcacacacagctctcttcttcacggtccagctgccccttgtgtgcccacccacccacacatgacccttatggcctgtggctgcagagtccccatctgccccccgagtcttggaacctcccctgaaggacttacctctcggcatgggggtctgtctgggccttgcctgggtcatatagcccactgaaggtccagcttctcctgccacatctgtctctcagatccggctcattgtcctttagttaagtcaagcatggcggcacacccatgctctcagcccacaggcgtagtggagggaggaccagttgttcagactcaccctcatctgcgtagaaagtctgaggctagcctcggctacctgagaccgtttgacactgtggttctcaacctttcatacactgtgacattctaatacagttcctcatgccgtggtgacccccaaccataaaattattttgttgctatttcataactgtgattttgctactgttagggattgtcatgtaaatatttgggaggtaaaggtttggtaaaggggtctcaacctatacatgggttgggagaccctctgatctaaaacaaaatggctccggtagttaggagcggttgacactcttgcaaagggactggctttgggtctcagcactcaccgggtggctcataatcccctgtgactccagttccagagaatccagggccctctctggctccatgtgcaccaagcatccatgcagtgcacgtctatacatatagatcacagatgcacataaaattaatctttttttaagtccccaaatctccttaagcccttagtctctagcctttcaatgcttttaagatttacataagtgagtcacccaggccctcgctctaacattacttgtgactgtgagctgggacgcttccctgatgctcagtttcccttctctacagcagtgttacgatgtggataagttgcccagtgcccataatatgcatcaccccaaggacggtgtgaccaggtcccacaaattcatgcagtgaaagtccttgggagggagaggaagcgtgggggctgggagaccgttctgtctgcagagccatcaataaacgaggagtttcttccccgggacccacagaaaaggccaggcatggcagctactgcctctcacgagccctggagagacagagacaagagagtccttgggaatcactagccggccagcctagccagttggggggcttccggttcagtaagagatggcttgaacactaaggtagagaggcaagcaagatgcctcagcaggtaaaggtgcttgccgccaagcctgatgagatgggctgcagaacccacccagtagaaagagagaaccaactcctgcaagttgtcctctggtctccacacatatgctgcacccacgcacccccacaaacacacacacatacacacacacagataaataaatatatatttttaaaaagttaccaactgttggagaggggggctggatgattgaggaagatactggatattcctccacactcccatgtacaagtatccttacatacatgtacatacatgaatacatatgtatgcatgcacacgccacacacaaataaggaaaagtggagtaagcataggtgtgtgtcctcagtcccctgaggatgaggtatgggggtggggaggtccaggtgtccgtctgatccctgactgtccctcagcctcgctcagccacacacaggttcccgagaactgcagagacccagagccacaacccaggagcttaaagcaggaggtgcttctcctctgacatcccaaatcggctgtccccaggggacttctgttccagcctcctcagctctccatatcccaggctccccaggctctgcctctctctcctcgtggctctcagatccaggcatctgtgtccagatttccccgttgacagcactggcctgcagttccccctgacccgatcgatgtaagcttcttttaacttcttttaacttgatcacagaagctagggctcagataaggtcacacactgtgcaggtaccaggatcagagtgggtatctggagagtcacgatatggctcatgtgttcaaccccccacctgtcactgtcctcccttccagagccaccctcaggcctgacttcagtagacatgggacagaagaaaggcttcagtgcccaaaacctcatgttttgtttgatgtttgaaacaaggtcttcttaggtaaccaggcggcccttgaacttgcaatgcccctgctagtacctccccagtgctgggaccacagctccatgcctgcctactgggttttaactctgcaaacaggaggctaactcacaccaactcatgggagggagggcctcttaggcttcagaccacttaattgcaagcctttttctcaaggaagcacagcgccccctatgggccaaatccatgaacacagtgatacaggatgctggctgtatcctgaatgaagcaagggactttggtggacgctctgcagtccacatgccttctacactaccctccaagtcattcgtgtgtggggggattattttatgcttattgttctgagtattgaatctgagtctattttctatataaataaggaaggggttttttttgttgttgttgtgggtggtggttggttggttttaggtttttggcagttataaatgtgctcagtttcctagcattagatctgacaggaaagctgttataattgaatgtgaaacttttccaagagattccttatttctgaaaattctgtccctgatggcaggggcaaccagtatttgaattgcaaataccaagcgcccaccagcctgcgctgggaaccagcagcctcccagggaatctgtctccttgctggcacctgactgccacctcatgtctccttgacggatgtgccagagacgtttccggttgaagcctccctttgttataaatctcccagcttttatttttcttgaagattgctgttctaatgttctttcaactttgggagatgactggcataggaaattatttttcgactgtgaattccttttgggaggaaatacggcaaactcattattataggaaagggccattggtgagatacctctgagagcagctccgaggggtctgatatgtcacgctccctgaggtaatgggaatttcctatagttgatggatcctccagtcctgctgtaaaggctgctgtggattgtctgcccctctgccccacccttctgcacgtctgcagttgagagggcagagggctgggaagatggcttagtggggaagccaacaaggaccaggcccgatccccagcatcctggtaaaaggcggggtacgaatgcccatctgtaacccagtctccaaagaagatgaaatccctggaacaagctggtagaactggtgaagtcggggttcatgtgggagaccctacctcagcatataaggtggagaataatccaaaaagatatctgacattagcctatgctaatgctcacacacacacacacacacacacacacacacacacaccaaagggatgcacacacacacacagcccacaccacacacactcaccacacacacacacacacacacacacacaggaatgcacacacatacacatatactccataccacacacacacacaccaccacacacagacactacactacacacacacactaccccacgcctgcacaatacaccacatacacacataataccacacacaaacaccacaggcatacatacacacattaaaaggaaagggccaacagtatagctcagtcgggagagcactcgcccagcacacaggaagccatgggtttaatccacatcacttcataaaggtgtgggggtgcacacctataatccaagcattggaaagctgaggcaggtttgagagttcaaggccagtttgtcctgatagtgaatcaacaggccatagagcctctccctgatgctagctagcctccctcccagctaacgaggttttctggaaatgaatggactctgtcatttgctacagctgcctgagtctggcaggggaggctgaagcctgcattcagttagaaactcaagcaaccccctccaggtcccctgcacccactgcccagccttggcctgatgccctggggtcctctgcaacccaagctctctccatagcaacagtcccactcggaacaagcaggtaggaaaaaggagcctagaaagggctcagccctcagtccttgtgagctgcctggcccttctttcccctggtgactagccaaccacccctactccccaaagaggacaacagggggtgccttgaaaagctgcactctgattgaaaccctcccctggctgttctgagttcctgagataaacccacagctccttctatcgggctcacctgttcacgtctctcctgcctctggctcttctgttccattcatacgcgggccactgaccctctctgtggtacggtcatccctgccctggcaccttagtacttgcttctgtataaaacacacttcacccactcccctgctgtggagaactttccagatccatcctcactcttccctggggagtcagttaccactccctacccagtcccagttatacaaagatgagtacttgaacacctgccaggcagagacagaaaacaggcatccaccactgaaacctagtggtggtggggctggggatgtggctccgtcgggagctgtgtggagggctctggatttagccctcggcacctcataaaccaggcatgctggcacatgctggactctcaggattcagaagggagaggccggaggatcgcaagttcaaggtcattcttagtggcacagctatttccagaacagaccgggctgcaaggtgccctgactgaaaaaagcgagggagggagagagggaggaagggcaggcagcagagatctctcttaactagggaggctgcttttcggcagcctctgaccctctgcatcaccgccatcttcctctgcctcacttacctctcacatgtcagcatccggaatgtaaccaaatgtagcgagttgatttatcttgtgctttggcagttcaccattcaaacacaaagagagccctaccgtaaccgtgagagaggcagccttaagtgaaacagagccaccggcagttctcaaaagctctcggcctagcctgagtgggactcgggaggtttatttaacatacttccacccctgcctcctcagcccagacggtttgtctgccaaaaacctgaagacttcaggcctgtggcctctcacacgtaatagctatagcagcctggactttgtcctttgtccaccttcttttgtggctcagatccccagatcccccagcctagtgggattgtctctgacactcagaccagggacctccacccccccaacccgtagcccccaaacccaatggcagcaggtcaaagctgcccagttcaggatgtttctagaacgacaggtgccagggatgggatctgaattcctgggtctactgatcttctggttggtatttgttaacgtgcaggtgacaccgttatccaaaacagctcctatagggagcagatgaatgcggaggtgtgcttccttcctgtgacagcataatcagaagtcacacgcattccatacgctgctgtaggttgtggaagaagatgcccagagtcacaaaggaagccagttgcatccaagtgtcttagaaactgccatgtgtgcctctttccacatttccaggtcgcatcactgatggtgggcaggtctggtaccagaagtgatatttcaaatatccatggtggctgtcttgggataggtcactggtgcctacgtccaggttctgtcagtggagctttccctcaggatagcagggcatgctagttagaggttaaagaaaataaacgcacatgaattctcccacccaagttcacagactgcctgaattctggctccaaccagcagattaggaaactcttcctagagctggagagatgactcagtatggttaaagggacgagagagaattcagttcccagaacccaggtcaggcctgtaagtcaactccaggggatctgatctctaccacaacactacattcatgtacacatgcatgcatacacatctgtatactcatacatacttgcatatatatacatacaaatatacatatactcaaatacatatacacacttaatacatacatacatgtacatagagacatacagacatacacaaatacatacatacacgtatatgtatatatacatacacacatatacatacaaatattcatatacacaaatatatatacatacacataatatacacaaacatacatatatacacagacacacacatataaaaatgaaataatttttttcttttactcttgaaagaaaagaaccaccaccaccaccaccaccaccccgcttgctgtggcacacgagaataatcacttgggaggctaagagaggagtatttcaaaatggggttagcctgagctacgtggtaagtctggtctcacagaaaagaactccccctagaatatattagaccccatagccatctcgtgccactagaatactcagcagccagagtcctccatctacccctccccttccccctgagccctgtccctgtgtcttgcccacatcacgtccacctcagtgaacaactagtgcctcagcatttccacacctgctctccttactcctgatcaggcctgctcctgccacggtgtccctgtagattcagcatccacacatcacacgaccaaggcaaaaggcagactcgaagccctgcaggctcctcgttagaccggtgcccacagcctccgtggcctggtgtctgtaggggctctcacccctctgctgcccaaccacaccccccacaggtttgagggcttgctcatgggactgtcatccagacacaggacgcagaagaaacagaacaagagagccttttcctgcctcttgagctgatattcgagttcagttgcaacaacaaaagctgaaacaaaaattgcaaattgctgacaataccatgaagaaactaagtcatgaaggagaggcccctcgggggtgacccagcaaacctctggcaaagctgaagaatggagccagagcatctgcagtagagaaggtcttcccaggacaagcaccagggcaaaggacctggggcagaacaggcgctgcctgactgaggggagagctggggaacagagtctgtaaccagtaggagattgttacgcaggcgtctacaggctgaccagactctgggttttgttcaagtgtgacatgaagctgatgatggggtttgctaagtatggtagatctagactggtggcttagagagtgtctctggccaccatggaggagggaccgagggagaaggcaggagggctgacgaggggactccagccacctccagacagagaaactgagggtcctatcctggacctgtgctttagacagagagagctgccaggctgtggagacagtttggggcctgagaaggagattcaaggtgtggcccttctgaccagagcgctgggtgaggagcagactgggggcagatgggaggccatactgggaaacctgcttagtgtcaaatgagtcagtttgcagggaaataagagcacaaaaccagagagtccattgaaaccagcaaagcccatgcagaggcagtgacagctggagcagagagctgccgtgtggggtgacgcccggttctgttcccccggagccctcgagtgtggagctgaacagtctggttttggcaggctggacttgccatgttctgcctcattcaccacagaccttccccattcccctggggaatgttgtttattgtcattggctgggccctccatcaccagtctctgctaatagatagatgtacgtctctctgggcaggcgtacttacagtcccttccttgtcccaggagactctaggccaagaccagtcacatctggtttcagacaaatgttttcagttcttgaaacacacacacacacacacacacacacacacacacacacacacacacacattaaaagagtcgggaccctggtttctttggtgttcttcccatgagctaactgtggctacactggtaactgtcccattggttaggcgcagtcaccaaggcagagtagaaggctcttgcctgagactagctaggcctgcatgctctgagtggaaacgaggtccttcagactctcaggccacacccttcttgactataggccagtgtgaatattgggagatgtgattgtaatccccttcccctctacctgacagtgcccggaacatgtacccacatcgtgacagacataacttcatcactgtccccagggaggtagcgacacccctactggccccactcaagttcatagtactctgcacacagactgcactcggctgacacacacacacccccttcccctgcaccccattcttgtcacagtgctcttacagatactaaaatagaaagcctttgggattctggtttggtttggtttgaggtttattttagttactctgtgtgtgtgtgtgtgtgtgtgtgtgcgcgcgtgtgtgcgtgtgtgtgcacgcgcatgcatgctcgtgtcacagcatgaaggctgaggacagggaatgcctcacagatgtcagtccactccctcccctgcatgggttccagagactgagctcaggtcatcgagttggcagcagatgtctttacccactgagccatccttccagcccacagaatgcctttagaatacggtacctgcccttgcgcagggtatgtgcatcggcctgaatacctcagccagatcgatcctgtcagctgctggctcatcacatacccggttttagcaggtgcccactggggctacagtgtccagacgggcttgtgccctctggacttgcatccttggtggaggggagaaacatataggaaagtgggtgcctcagtggggtgatcccagagaaactgagaagaagtgaccctgagtgcagagacaaaggggaaggcagggtcatcttgggtcagacatcacatggagaaggggcaggtccgtgagaccgacagaggggtgtccaaggcagagggagcagctggtgtaaatgtcctggggcgtttaagatgctggaggtcggaaccctgtgagccaagcacaagtcactgtaatggagtcaatggtcttgaattcagaggatccttctggctatttgtggatgattgattctatgaggagacaagaggggagggaggctgaagtatgggggtgagtggataaggtgtgcacatgttctctctctccctcccttcttccttcccctgaaaggtcttgtatgcatttaaaataagcattctaccaatgagttaaaccccagtccctaaacttctctctctttgtggactgtcttacccagtgggctgacatgggctcaaaagagccaccaacttgggtacagctcctgaacaatggtttcctgctcgcttcttgggacagaacacccttttctgcttttaaggtctctcacctcaaagtgtgaaccacaggtggaagatgatttcctgtgctccagggacacagcagggcatgtaggctgacaatagggacctcagcgaccaaggcacagaagttggggcctgtggcttgtccagggttacaataaagaaggccaagaaagaggaaaccttggggatgtgggagtgaattgacttcacagtatggaagggacctgcccacgaaaataagtctttaatgaaatgtcagccacacaccgtgtgattcagcgggtccgctccggaacacttcgcctccttcactgttatttaccagttttgttgaatgttcgatgtgggtggaggtggtgtagggtgagcctatgccaaaattgctgttgtccttgaaacagccctgttcacagctctacccagatggccagggaccagggagggaggaacggtctgtactacactgcaggctgagctagccctccaggcagccctacagcagacctcaggatatatctatcaccatctcatcttcagtaggtgcctggcctcttgcacagcagtaaaccctggtgttcagccgtcaggaaacaggggtgatgccctctacatgtgttctgcaaggggctgacaggtccaaggtacagatgtggtcactctgcaggcttgctcttatccattctgtcacatgcctcctgcagcacagggtaaaaggggagcatgcacacatgcacacgcacatgcacacacccctgcacatacatgtgtgcatgcatgcacacaccacacacagttgccctgagattcccattgtatcctccactgccctcagactcgcagcgatgcctcccaggctctccgatgccaggcatcctgccagctcatttctatccctgatcgccgcacgacacagctttttcagaccacaaacacattgttatgaggccatttgagtttgtttcagagctaggagagataacagaagggtctgggcctcctgtcaggcggcgaatggctccccagcagcccttaacgcagacaagtggagcgagacagccaggaggggaggcgcttgcctgcttcaaatgttaagcaatggacagggcagagggaaggactgggggcctgatccctcacagaggaaggtgagcacacaggtgatttcccatatctggcatcagttaaaccaggtgctaacaggcgagaggctgataaaccaggtgctgacaggcgagaggcagataggatgcagatagatgcttgttacgatgatagtttaactttaggaacttgtgtcgtggttttttttttttttttttttcgaggcagggtttctctgtgtagtcctggctgtcctggaactcactctgtagaccaggctggcctcgaactcagaaatccgcctgcctctgcctcccaagtgctgggactaaaggcgtgagccaccacacccggctttgtgtcatggttttaagcaatatacctgaacagtcagcctacatctctccaggttctacctccaaattcaaccaccaaggatcggaagtgttcagaaccaagtgcagacgtgctggtcgagtctagattagttttcttatcatgatatcccagactagagggcgtaataactatccacagatcattatgtcaaactgagttgtctaagaaacctgggaaccagcttgagtatcttggactctgcatgtgggcctgtggtctggaaaagctgtgtctcaagttggaatgagcttctggtctccacaggccctggaatccctcacccacgtgaggaaccactgttaacaggcatccagagagggacattattgtctccattatagatctaaagagccaggcacagtgtctcagacctgtaatcccaccactcaggaggctgaggcgggaggatcaagtgtcctaagtcaacctgggacacatagcaagaccctatttcaggaagtaaagaaagaataagagatttgccaagggcacactgctgggggattactgcatgcgtgaggatttgggaggtgatggatttgaagttgttttgtttgtttgtttgtttgtttgtttgtttttacattctttgcgtgtgtgcgtgcacacctgcatgtgtagaggacagaggacaactttcagaagtgtcttctctcctcctacgacatggtccccagggactgaactcaggtgtcagacttggcaacaagtgctttaaccccactgcaatatcttacctgtcctgtttggagattttagagttttgccgggcaatgtcgctttctttgggaaaaggtctacagtttgcacaacacctccacagaccctacgatctgtaagctgtccctgggtccctgtgtcatgggtgtccattattttttgtcccacccacttctcttcactgacatcatttaggattgccttcagctaaggtccctcggctaccagtggcatctcaggagcgctgacatccctgtgcgtttcttgtgcctgccgtgtctccctagagtcctctctctgtcaccaagctctctctggtggcatctactttatagaacatgtgactgctctgacactgggtgcctgaggcaacacggctctccactcgggaactgaatggcttgtgtagcaatgtgtcaaccgcagactgtgcaggaagggacacacttgacccttgatcctgatgtcccgtccacacagtctgccctctacacaatccatttatgccctgtgctgacaggctgcacctcgtagcagagggcatttgtaaataaactatgggagctagatgcttgggcatcttttcagagccaggaatcgtaggccacagtcaggacaggatgtgtacatctcttctccaccgtaagtgtaaggcctggacgtggctcacaggaccagcttgctacataccctttcaggggttatcagtccagccctgctccctggggacaggcatcagcttgcacactgtctctggcctttcctgacctgccatagtcttcatccgctgccaaactcttctccccagcaccggcccccaggcccctccttcatgggcatctcagccaccgccgctcccagagtacaggttttccagctccagctatgatccgggctgcgcttctcgccttggccctcgctccagcttgctctccctcttggctgcaactcccagcccccggcccacgctaatctgtttctcccacctctcctggtgccgggataaccattttaaaaactgccctcgggaaatctaatcaaatgagagcaaaatctaatttggcactaaaagcctctgactgaagccctgatttctggagctttgtggagcctggataataatgcctttctgggtttcgcaaaggtccaggactggggagaagagagggcgagagaactctgatatccctggtatggaggatgaatgggctgggaagagcaccgcttcctgagccagctggcctggccacgcaccgagagttctcagcatttggagcacaccagcaccacaaagcccttggcctcaatctttggggatccccagctggggacccagaagagatgggaggaaacccagtgccaccatgaaggttcggccagcgttctccggttctctctcttatctgcacagtgagagctgacttgtacttcctgaacaagctgtggccctaggttccatttagggcatgccgggggctgtgaacatgttccttcaagcctgtccccagcggtccacttggctaaccaggctgcatgtctccgtgcttacacaacttattaaaacagtgccacctgctggaggtcaagttcaaatatctgcacctgtagaacacattttagactcaaaccctaccaccacctcagggagtgcagtctgtaggtgacaaacccacacggggaatatatgacaaaggctgttgagcggagcagaagccacacatgccctggggctgttagcatacatcagcaattccatatgctgtcactatggtttttattgacagcgggctctgttttcttatttgtgcttcagtggcttcaagtgggaggcttttccatccctgtgcatatatttttttactttgtttgtttgtttgtttttgaaattttgaaacagggtttctctgtcctggttgtcctggaactcacgctgttagaccaggctggcctagaactcagaaatccgcctgcccttgcctcccaagtgctgggattaaaggcatgtgccaccactgcccagcttaattttctttctaattgtaatatattttaaatttttatttatatatataaatatttatttatatatatatatatgtaaatgtgaggatatgctgagtgtaattgcccaccatggccataagagggtgccagatctcctggagaggcattgtgtgcaattgtgagccacccagcttgggtgctgggaaccaaacctgagtcctctggaagagcatcatgctctcactagctagcatctctccacaccccctctagttatcctagggggaggagtgatggtgttctatttactttcttccttgttgaagtctgagccagcacagaaagaatggtgacaaggttgggagccagcctggatctgggaaagccacagcggaagggcctggcttcttcctgatggcatttgggcttcctggacgtacacacacacagagagagagagagagagagagagacagagagagagagagagagagagagagagggagggagggagggagggagagagagagagagagagagagagagagagagagagagagagctctgttctcaaaggtcccacgtggaagggcccagcactgtcctctgggcccagagcagcccagccccctcctgccttcccctgcaagcaattccttccctatctctctctcttattttgagagttgcaccagcacccactggttactccacagtcacggggcacagctccgatcagtatgctctcaagttatcctaccctcctaccacagtcaaggtcctgggctggccttgctcatagtggagtgacttgggacctcggtgtccctgtctggaaatagaggactggggtataacctatgcgcagaatagtttgtcccttaccccggggagaagctctgggtctcccctcctgattaatatggattgctgtggttttattaatggcggcatcattgttgaccaatacagacacagaaatccaccgtggccagatggccccaccaccaaggccacgggggtggggggtgggggtgggggggtaggctctatgtttctgtaagaaataaagcaggggtgtagtgctaaaacccccagccccttccaacctcatcccctccctgcacccacacccaccagcttcatagatttcttctgcccagcttttgaatttatttaaattagatcatttaaaaatatcactggaaagagtcttacagaatgtctctctatctggtctatgtcttatactgttagcatgcacccacactcataaatgtagcacaaccttgtgccatattttattatataactatattccatttcatccacacatctttcagctaatgaacttgtttctatttgctttctgagtgtaccactgtcagctggccctgggtgacttttgatgaacaactgcatgctgtttcaaactgctggaccagagcccatgttcaagtttgatagaggatgccaaagagattccaaagtgttgggccagttgacacacccccagctattttcaagaacctcagttgctccccgttccatcaactcttggggtgctgtcaatttatctgggactggggaatacaaactctagagcacccctaagcctgaacaaggggtgtcttagtcactgttctattgctgtgaagagacaccgtgaccaaggtaactcttataaacgaaagcatttaactggggttggcttacagtgtcagaggctaatccatgatcaccatggcggggagcacaacagcaggcagacagacatggtgttggagaaggagctgagagttacatcttgatccttaggcagcgggcataggggatgagacggcctggcatggacttttgaaacctcgaagctcacttctagcagcagacctcctctgtctgacaagggcacaccttctaatctttccaaacagttcaccgactggggactaagcatgaaaacatagtagtttatagcggccattcttactcaaagcaccgctttaaaaagggaccagctctcttctcactgacctacggcagcagaaaccaacctgtctgcttccaccatgctcacggccacaaaccagagtccagggctttatcatccataggaatcactgacttgtttgtttgtttgtttgtttgttaagacaagctgtagccctggctgtcctagaactcactctgtaaaccaggctgaccttgaactcagacattcccctgcctctgtttcccaagtgctggtattaatggcatatgtcaccaccacctagcttgatctcttattttttaaaggacatattatctattgtaaattattttagtatttctatagccgtatttcaagtcccttgtttcttccctgtgaccctactatagactttgaactcgtacacatgtacttctgtgaggaggggccctgggctcccccttcctgccaaagggcagaggggtgtgttggtctctggctgtgaacactcaagtcagtcagcatcactgagggttgccaaggccagggctggctgctctcttgctcacctctgatcgccgatctcttccagctttcttcggaaaatacctcaatgagtacaacggctcatacgtgccgcccggctggaaggagtgggtcggcctacttaagaactcccgcttttataactacacactctgccggaatggggtgaaggagaaacatggctcagactactccacggtaagctgtgcacccccaggccccaccaccgcctcccgagccaggggaaccctactcgtagctcaccctgtggccttggagaggatgctcgtgcctaattagatgtgtggccttgagcatcgtccagtgctgcttctcaggttccccatcgctccactgctagagttaactcagatgccacctcccgaaagaggccccctcactgttccagctaaatgacgtccccaagcccagtttctggagtctgaactccaacattcaacagtgacccagaacaccttgatttctctgtaccttcgtctctaaggagggattgttaccatgtccattctcagaggaccataaacactcaattgtggtatcgttattcttttgctgcccctcccgccatgttcccgactctctcctgctctcttttccttcgccaaacctcgagtgttgtttcttttgtttctgtgataccctgacaaaagcaatgcctacatgccggggctgttccgttcccctgtctgtctgttcaggccaggattccagccaagggaatggcgccacccacagtgggcaagttttcccacctcatttaaagcaatgaggataatcccctccacagaggtggccaagtcagtctcccaggtgatcctgggtcttgtaaaggtgacagtggacactgactgtcatggcagctgtgtgttgtgcttgcctctctgctctctcctgccatcacctccttaaggacagtgaccaaaccatggtcatacccctgtccctgatgcccagcacagtgggtggcacctagggagcactcggtataaatctcccggtcctcaccatcctcccatttctcccgccccaggattacctcacggatctcatcaccaatgacagtgtgagcttcttccgaacatccaagaagatgtacccacacaggcccgtgctcatggtcatcagccacgcggctccccatggccccgaggactcagcaccccagtactcacggctcttccccaatgcgtcccagcacatgtaagcctcagcctccactgggggtgggagggtccgtcagggcttagggacaatgggacatcagcaatgtagttgaaccttccttaaaacattcctggttaaagggcccaaaagctaccatgccagcacttgagaggtcccccaggagggtcaagagtacaaggccagcctcagctatgtagacagttgaggctagcctgggctatatgagatgctgtttcaaaaaacaaatagacatcaagagcagggaaaggggaagctatgtggggagatggttccgttgctaaggcacacaaagatcctgggagaccggctgcttatcaggtgcagctctgcggcacagaccagccagcctgtccctagcccctggcagatgccttctggctgggattcatctcctcccactcagaagctcagcatatcccctgtgagcctgtgtttatgtccgacggagcctgtacaaagtgtctgagagggggaacttaggagagattgacttttgttcccagttcaaggatccagcccatgatggctgggagggcatggtggccagagcaggaggcagctggtcacattgcatctgcagtcaggacacagagatgaatgctgacacttttatccatctgtccgggaccctagtctatggggtggtatttcccacatccgggcaggttcctacctcttgaaccaccctcacagtccttaggtgacggcaagtccagcctgggtgccaacaaacaccatcacagggtccacggctacaccagctactggccgtggaaaacctcagatcttcatggtgaccctggtgtaccagttctctgttgccacatagcaagtgactccaaagtttaacaccattgaacaaacagcaaacacacatcagctcatgaccctgtgctaggagcctgggtcagtgagctgacgtcctgaccccgatcttacttctagctgtatgggcctctccatcttcaatccagaaagagaaagaggcaaagatggaagcaaccatcccatctccctgcacagggcacacacctcactgtgccatcagagaagcctgcataggagtgtgaagatcaaaagagggtcattaaggccacctttgatgctgtctcacttagtgtccccattttacagacgaggaaacacagaggtcacccagcttcgataccacagaacctggattcaaacccagcccccacccaggcttcccacctcaccgccaccccgttagctagtacagctttctagaagatattctggcttttctcggcctcagactatacctcaggctcagcagtgacactcagcagcccttgctgtgacattctggggtagcaaggacagggtaatttggactcctccttaatatccagggtgtttaattttcattacggtcagaatgcgccaccctcccctcccccggctcagctctaatgacttcctgacagtgtgccacccttggagggattacagggtatgttagccttctgacccctggacttctgggaggagcagacaggagataatgaaccacatttggggagcagtgggctaccctcaccctgagagccccatagagtgtctgtctgcctggctgccctcacccattgccctctaccctccttcccagagagagaggccaacagtgctccatcctgggccaagttcctaccagaggggtgtgacatgtgacactgcctgctcctgtactgtccctttgaaatgaaattacagactctgacaatgaatagcaaggggcttgcttgtccagagactctccaggccactatggtggctctgggaggctcctgcccctggaagacagtggctcctaacagttctgcaggatggtagctggtccaggagaggaaaatggtggcgtgcagggccttctggtaggcatctctccctcaccaagccagcctgatccatgcccctggagcagacttttcgtgctgtaacaaacattactgagctcatgacagccctgctcacttccctctgtcctcccagtatgccacacccatgcagacacgctttcagatgctgaaatatagacgcgtaggaacgtggggcacatagcacatatacacaaacatacatgttcagacacatgcatgggcacgtatagatccatgtacatggcacatatatagagacacaccatacacatgcagataaatacaacagtcacaaaagaactcacacagagacaaacacaggtaaacgcagtcagacacacaccaccaaaacaaccacatgcacacacaaacacacaagcacaaagatacacagagccatacatgactaggtgaacatacagctacaaaagctcacagacccgcacagacatgtgcacatacacctggcagccctcagcacttcttccagcatgtgatatctgggagcaagacctcccaagacctgtgaagacaggggctgtgatgacatcacagcctgctactctgaggctcatggtataaggggtcccactggacgatatgaaggaggtcacctctgtgcatcacctcgggtaaggaaaaggggtggccaactgaaggatctttggggacacccagacactcttcaggtatttgaggagcccagcctgggccaggtgactagctggctggcccaggtcctgagttaggacgcagctctctagcttctgattccatagtctcccagagtgaaaggctgacaggagtcactcactggctcccatggtcaccctccacacaagagcctgccagacaggcctcctagtgaagtcaaggatagctattgtatcctggtgtctaagctgggtcacagggagtgacttcctcatagtccagaagacagtgtggctccaccactacacaggcagccccggcagccccttctagctccctgagacaaggaggcatgcttccaagaatgttctacacacaggtcatgccctaggccagccgcaagggacacgggcatttctcataatcaaagaccatgtgtgcagggagggatttagcagcaggaagcggcccagagctggggagccttgaggccctggcttccccacaagcacacagtagcagtttcctaactgttggactgctgcaagctaccatggtgccatctctgtacaagaccttttgacatgtgacagagtaccgaggtccctaggtagggccagtgcccaagctggtaccagggagagcactggctgttctgacaagaaaacccgcccctcctctgcctcacacagcctcccatccccctcctgactccactctgattagcctgtctgtctcgagcaagaaacaactcaactgttggctgtaatttcagcttactggggtagggggtggaacctgaggggactgggtgctcacattttgagacccagtggatggcagagtgatgccctcttccggtgggttaggttcagatttacagtttgtgtttttttgttttgttttggtttttgttttgttttgttttgttttgttttttgtttttgttttccccagagaaggtgtccctctctgttcaagcaagccttgaactcctgatcttccccacttagttcaaagagcgacccaatcacaactggaagaataattgtgacaaagaatcaaaaaacatgtcttgtgtcccaaaggtggacattcttggaatgcgtgggccctgcaggcacaactgtgacatacttaatttttacacctatttcttgctgtctcaaaccaagacttaatgcaaagagctcacctacctgtaatcctccctttaccagagtgacagccacctgtgtgctccagggctgagaagtcaatagatgcaatgcaggggtgggaagtggacctccagttctgggcctgagaaggctctcaactggagcctctttgaaagggttgataaatgaataccagaaagttttcaaaggaagactcatgccaagctgctggctttctgcacttgggggaattcatgtccatttaaggctctgccacctcctgaaggtggctccctcccatttacaccttagaccagtccacttgcccccaactggagtgagctgttcacggcacttgtcttgactgcctttgtttgccaccagcacaccgagttacaactatgcacccaacccagacaagcattggatcatgcgctacacgggacccatgaagcccattcacatggaattcaccaacatgctacaacgaaaacgcctacagaccctcatgtctgtggatgactccatggagacggtaggctccgcccctgccccgccccctggcaagcctctgacctaatctgaaaatctaagtcaaagagccaaacactatgccaacttgggaaaggggcttggagcaatccagagggaaggcttttgactcctgaaattttcccatgagtctttgctgcttgatgaaaccacagtctttgctgcttgatgaaaccacagctgcttttctttcttaaaaaaaaaaagaaagagggggctgatgagatggcttatcggttaagagcactgactgctcttctggaggtcctgagttcaaatcccagcaaccacatggtggctcacaaccacccgtaatgagatctgaagacagctacagtacacttacatataataaataaataatatctttaaaagaaagaaagaaagaaagaaagaaagaaagaaagaaagaaagaaagaaagaaagaaagaaagaaagtcaggcgtggtggcgcatgcctttagtcccagcacttgggaggcagaggcaggcagatttctgagttcgaggccagcctggtctacagagtgagttccaggacagccagggctacatagagaaaccctgtctctaaaaccaaaaagaaagagagagagagagagagagagagagagagagagagaggggaaggaaggaaggaaggaaggaaggaaggaaggaaggaaggaaggaaggaaggaaggaaggaaggaagggactagagtctcattctgtataacccaggaaggtgtagaactcattaagtaactaaactggcctctaacccatgaggagtctcctgtctcggcctcctgagttctagaattacatacaaaagctaccatgcttggctgcttttatttcttaaaaaaaaacaaaaacaaaaacaaaaaaacaaacaaacaacaatatcaaaaacccacttaaaagttcagtagctttattgagctataactcatacactcagttaaagtatacaacacaatggggttttttgttttgtttttaagacagtctcctgtagcccaaactggcctagcactcacctcctgccttcacctcccacattctaagattccggatgtgtgcctcgtgcacggccctcactgacttgcattcactcagagttctgcaaccattaccactgtcaagttagaacattttcatccctccagggggattaaacaccttcccttagctgtcaccccgtctctgcaggtactaaggtcttcctgtcgtcactctggacatttcatgcaaatggatcataaaaatgtggcctttggggactgccttttttcatgaaagcacagttttcaagacatggcgaagtctgtatcacaatgtccaggacccgcaggctggggaagtctgactcccaaaagttgtcctccgactttcacacacgtgatagaatatactacacacacacacacacacagagaatcatattccactgtgtgggctaacagcttactcaaaggggatccatagctatctaaatttaaatcaaaatactataaaattcaaactccattccttggccacacacaacatagttcatatgctccatagccacgctggacagttgcagaccctcatgcaggattctgtttcaggttaccaactcccaccctggccctggccacatctagcgttgtttccttccttccttccttccttccttccttccttccttccttccttccttccttccttcatgcattcatgcattcatgcattcattcattcattcatgcatgcattcatccaaggtcatttattaagggtcagtgcaagtgcaacacagctgccagagagcaaaatacagagacccccacacagcaagaccccaccccataggaactgtccacagacaagggacagatgttaacaagtgtaagagacaggataagggagtcagttccgggggccttgcagagaagtggacttgccccaggcatggtcgagatgggaggtgtgctgagagcggagggctcccacgaggccagccacctcacctctggcctctgttgcagatctatgacatgctggtggagacgggggagctggacaacacgtacatcctgtacaccgccgaccacggctaccacattggccagtttgggctggtgaagggcaagtctatgccgtatgaattcgacatcagagtcccgttctacgtgaggggccccaacgtggaagctggctctctgtaagtgtgtctcctgtgcccgtaccccaggtcccaggctcacggggagaccttggactctgcttggtctgaaactcagcacaggtccaatccacgcctctcaggggcaagattctagaacagttgtaccagccattgtgtcggccagggtggactccgaggagggtcatacccttctgaggcggaagccaggagctatgactcccatgaaaaacagcgaggcggggttccgtgccaggaaatgccagagcctgggtgttgccagctcatgggaaggttctttgattcccaccccgtctgggcagtcactggtctggtggctgttgaggaagagatctcagacttaagcagagagccattgtccactgggcctgctcctggtggcaacaccgagtaagctgtctgccgtctgctctttcctcaaggaccgtgtgggccatggccttagccgttctccttggcctaacctttgaagtggcaaccggaaacagaaccgcttagaggaggcagagttgaatgaaaggctggcaatcgcggccgcctcatctctgtagcagctggggggctgggggagggggggtcaaagtccagtcaggtatatccagagggaggactgggacttgcacagcccatcttccacgccagcaagggagagaggcaggaggataccgccagtgagaccgctgaacatctgtccacagaacagctggagcgccaacccatccctcatagtctttgccgggcccctctcacatgggtggctactgagtggatcaccctaatgtgatcccaggagtggggtccccaagcctatggggcttgtcaccagactccttgttaagagctaaaagcgacacacggctgcctcgaggaaaatcattctgggtcgagtataacaggtgctcagaggccagactgtgcgtgcccagccagcaagaaccaacaagagggcgggcatgaaccctagaggcagaggaggatagtattagggcatgtaaccttgacagtgcagcaccggacggtccggctggaactggcctccctacgggtcagagtgtcaggatggaagctctctcatttgcagatgtccctccctcttcacctccagatgcctctgtcccaagctaagctgccacccaggtggccaagtttccactccctctctgttccccaggaacccccacattgtcctcaacattgacctggcccccaccatactggatatcgctggactggacatccctgcagacatggacgggaagtctattctcaaactactggactcagagcggccagtgaaccggtgagaaggagcaagagagacccagggaaggaggctccctagccagggggaactcaaccacggggaactgggaaggccactggaatcaggatctaggtgccccccactaacccatgagagattgaaggaccagccctctctgggattctatcctcccatttggagctaaggaccttccaaagctaaaaggatgaaaagcccaaagttaacagtagcactgtgctgtgccccgggcactccagcacgttggccctcatagtaacccagtaaaggaaagttgtgttctctgaatcctagagagatagaggataaccaagaagtcagactcttcgtcacaatggctatgacttttgtggccctattgatgggtggtgggactgaccgggagtgtgttccaggtgtcctgggtggctgaaggaagcagcaatgaaatggggaaaacaaaacaaggaaggtggaaaggaaggtggctagagatgaggaaccagaaaggcaggagcgaccccttgtggtcaacagtgaaactgccccctggataacagatctttctgtgagcctctcctagactttcctcccagggggcccagccctgagatctacaggtggctggtggccctgtaaggtcggtacatcttccaacgaagggggctggaagggtctaaaatggacacatgcagagtgtaggggcacaggacacttgagaatcggggaccacaaggggtcgctcctgcctttctggttcctcatctctagccaccttcctttccaccttcctttctgtttttttttttttgtttttttttttcccccatttcattgctgcttccttcagccacccaggacacctggaacacactcccggtcagtcccaccacccatcaatagggccacaaaagtcatagccattgtgacgaagagtctgacttcttggttatctcatagatcaggagaaatgaccccctgcaggcactcattagcccagaactgggctcctgagagactccaaaactcacacacaaacacacacacacacgtgcaaatgcccatgtaactgtacccatttcaaccacaaagaggcattcagaacacatcttggagaagcagccctgtccctggggtgtggaaacctttccagtgtcactcaatgactgccacttggcccagggtatggagaacctgtggacagggctggggacacgggaacccggcagacaggatgctggacctgcttgttttctaggttccacttgaaaaagaagctgagggtctggcgagactccttcctggtggagagagggtgagtgccggccgggcaggaagacccccatgaggagtggtcacaagactgtgggaggctgaatagtgctgtgctagtgactgggtgactcagagctgtgtccaaattccctgtcacaattgggtggctcatgcagaattcgaatctggaggccacatgtccccattcaacatacttggcagagcctgtacgatgtcatcactgttcatttaatcctaactcaggccatctgggatagacagctcctgtagacttcccattaaaacccaggtgctctcaagccaccagccacccatcctccacagtaggtctccacagagctatgcagggccggcagcctaggcaagcacaagttgccccagggctccacccagttcaaccagccccgcatctccctcagcaaactgctccacaagagggagggtgacaaagtgaatgcccaggaggagaacttcctgcccaagtaccagcgcgtgaaggacctgtgtcagcgagctgagtaccagacagcatgcgaacagctggggcaggtgaggagatggcggatcttctgggtcctctggggtgtggttgccatggttacatgggaggctctggtccctgtcagggtagcagtgtcctctgggtgtgtgaccttgcactcctcatgtgggaaaacaccagcaggcaggctcaggtggcaaacagcattcattgcctcccagctgacttgtgtggtataactctctgcggctggcttccgtttatagggggattaggaaatagctttcaagattttttttttaaaaggacattgattgcaaaagagacgctaagtaaacatataaccctggtagtatccagggagagaaagagccggcgtctggaggaggcctttccaaggtgagctatagagattggggagggatagttagccgggcatgagcctcagagggcagggagacaggaggagaggagtgagagatgagggagagatgtgggcatgtggaacgaacagaagttgggggggggggatggcccaaaccaaggggagcgaggacagcaaggagctgtgacatcgcagactctggccaccgggtgagtggactggtaaggagagggcagggtgaaccagaccttgagaagtagtcaaggacactgggctactatcccagctccagcacacctccagttccccccagcccgggctatgtctggggcgaggctctcttcctcttagtgctttctctcagagtggagatcgtgacatagctctttcatgccaaagtttgagttgcactgaaagccgcatccatgagcactggaagagaatgggggagggaggctgaggaagagcagggattagaccaggtattagcagctcagatccaagggaggctgaccaaccaccatgaggacataactttaggcagacaggggctgtattggtgaacgccatggtaggtccagctaagtgtggacaggagggagaaacaggcagtcggagttggcacgggtgtggcatttgccaagctgagcgtgggcaggaggagaggtaggtgtggcaaacaggatggtggggatggggggggtgacacctgaagccctgctgtgtcccacagaagtggcagtgtgtggaggacgcttctgggacgctgaagctgcacaaatgtaaaggccccatgcggtttggtggcggcggtggcagcagagccctctccaacctggtgcccaagtatgacggccagagcagcgaggcctgcagctgtgacagtggcggtggaggggactacaaactgggcctggctggacgccgtaagctctttaagaaaagtaagtgtcaccagcctgcccaaagttgagaggatgagcagccatggctctggctgggccatgtgaactttcaaacaactccacaggtgctcgctccaggcctgcaggtgatcctaggagctagggacacagccaaagccctcacacaagctccaattcaagagggcagcagtgctgggacaggccactagggggcagtatggacatggaccaaaggcaggcaatggagccaactgggccctgtaggcttggtgtcgccttctgggggggggtggggggagtaggatggggctctaatctggagcaggcggaaatgataaggtcaacgggttctcaaacctccctcaaatgaccactctaatggtgagagcagcagacagacagctgagggactgacaagaagccaagtggcatgtttgggccttaatgtccaaagaggtctagttatgacttgaaggaaaagccatcagagcatactgaccacgtgcttccacagtccacactggcagatccccctgctcccaaaacgcatctgtggcccacacgtgtggaggtcgggtcatcttgcaggagttagctctctccttctaccacacgggccacggggatcaaactcaggtgtggaagcatctttacctgcaaaaccacctcactggctctcctgacgttcaagttgtttagcctgcccagtgtaacgacctcccgatgacccacttccggggatagctctcccaagcccgcacagcatgcaacactgagactggaacttggggttttacccctgtcttgattgaaggcccatggctggggctccctggacagcctgtcccagcctctctgacttatcatccctcctggcacccacagagtataagaccagctatgcccggaaccgctccatccgttccgtggccatcgaggtggacggtgagatataccacgtaggcttggatactgtgcctcagccccgcaaccttagcaagccgcactggccaggggcccctgaagaccaagatgacaaggatggtggcagtttcagtggtactggtggccttccagattattctgcccccaatcccatcaaagtgacccatcggtgagagtctggctggaggttgggggtagagggacaggctgggcctctcttctcccctcggggccggccactcatgaccctttctctggagcaggtgctacatccttgagaatgacacagtccagtgcgacttggacctgtacaagtccctgcaggcttggaaagaccacaagctgcacatcgaccatgaggtgtggccactggggcagcacaggctggcggccagcatccacaggaagggcggggggcctggtgaggggagaaagcaagattggtcccccagaatccatgaccccatcccagaataggaatctgagtcatggggtctggaagccagccaaaggtccagctcagagatggctggctggctggggacagcgcagcatactttatttagacctgtgagacacccccctatagagcttgctctcgctacagcctccgtaggctctgctggcggtaggaagagtctgttccttcagggaggcccccttccacgggcagagccacaaacgtagatgtggctgtacccttcccacccgcagtcaccctgtggttcctaggcttctcccattccctccctcagatcgaaaccctgcagaacaaaattaagaaccttcgagaagtcaggggtcacctgaagaagaagcgaccggaagaatgtgactgccatagaatcaggtgagagagcagccccggccccactcaagccctggacaccagtgcgtcctgcggatacacggggccctctcagcactggaccctgtctgtcaagataaggagccaataactctcatcagggaaactcagggaccgcccccgggggcggggtcaggctgagctgtgtttgggcaggccccagccttggggcacaggcttctgctcactgcctttgggaactgctgggctgccactcagggttctgcctgcctgagagaacttcccacacagaaagacatggagtctctctgcagtcactgtccagggtggcagtcacataacacctgtgactggggaacctggagcaagaattttccttggtttaaattgaaggagccacacagttctgaacacctttgctgactcgggccagtctcaaagcccccttctaagcatgaggtacatggtatgatacaaatcggccttcagaggccacggctgacaccaactgaagccaggcccagcctccagtccgggttaattatttccgtcctgaccttgtaaagtctgacatggggcatctaaaccaagcatggagctggcaaccagggggatacagtgccctccatcccacctaggaaagggtgcagtgagcaagagcagtgaaccccgctgcatgcctgccagagtatcctgcaaagctctgactcttggggactggggtgggggggtctgttgcagttaccacagccaacacaaaggccgtctcaagcacaaaggctccagcctgcaccctttcaggtaagggtagggataggccaaaggggtaaggtgccatgcctacctgtctgtagctaaaacacacaaggcacattcaggctgggctgggttttccctgggaggtgaggtctacgcagtccttggaggggccccaggttcatacaaagactggttagatatggtactgtagccacactaagcactggacacccatttctgccgctggtgggtggggctgaaggaggccagaggaggagaaaggccctggggtctggccctagctgtggcctggacaacagagggacttagagcccttgatgacgctgcccaaccactggggcgaaccacaaggctgaggtcattgaaccctcagaggtcctaagcgtgtgtggtcccctgtgccctcaggaagggtctgcaggagaaggacaaggtgtggctgctgcgggagcagaaacgcaagaagaaactgcgcaagctgctcaaacggctgcagaacaacgatacgtgcagcatgcccggcctcacgtgctttacccacgacaaccaccactggcagacggcgccactctggacgcgtgagcaaatgggcaggcagggcatgggaggcctgtgtgtgggcaagcagaggcaggcaggggacaggggagttgtgtgcatgagcaagcagggacaggcagagaatgggaggcctgtgcatggccacctacctttccctggcttcagagggccaaactgctagaggtgtcttagaaacctgtgcttgtcacttggcatttgagagcctgtctcggggaggctgtctgaccgactgtctctctgcgggcacactcaggacattcactcttccttccacagtggggccgttctgcgcctgcaccagcgccaacaacaacacgtactggtgcttgaggaccataaatgagacccacaacttcctcttctgcgaatttgcaaccggcttcatagaatactttgacctcagtacagacccctaccaggtacaggcatggtcagggagacagggagacaggcgtgtgagacacaggcatacagctgcagaagagaagcccctcacggcccctaagcctggaagactgagttctgaggccacttggagtctgggactctgtgttgtccacatgcgtctccctccattgccctgtgtccgatctacagtccagttcttccctccccctcaggcagactgcctacagagctcagcaggtacttctgtggacccttgatcagtagagctacaggatcaggccacgttctggactctctaggctgccatggagagtacagacaagcaaccctaacatttacccagcatgcacccaagacaagctctgtgcggagtctccctcctttggacacacctcagcacaggtgtgactgcagtggctcagagccgcacaagacaaccacaagcagcaaagctcctaaaaccagaaccctgctccttagccattctggaaggtgaccttggtaatgaccaaccactcaacctcattcaaaaagcccgacacagctccatacactgtgacttcaatatgtcagcagccatggcgcaagtagccagagaccgccagttttccttctctgacactttagcccatactttaccaaagagggtggcagacatcgtcagttagtaaccatcagtagtgccagactaggcaaagccccaaggtccctggcccacctccataccaagttcctccatcaagaggaacaaaaaggtcaaacctaaggtagacctgcggaacccggctatgcaagatacccaatggggggctggcgagatggctcagcgggtaagagcactgactgctcttcccaaggtcctgaattcaagtcccagcaactacatggtagctcacaaccaccgtaatgagatctgacgccctcttctggcgagtctgaagacagctacagtgtacttatatagaataataaatagatctttgggccggacctagcggggggccgaccaaagcaagcagaggtcctaaaaaattcaattcctaacaaccacaagaagactcacaaccatctgtacagcaacataaaaataaataataaataaatctttaagagagagagagacccagtgggcagctgcagaagttcaaggtgaaacccacaggcatggtttgtgtctcctctggaatttccatttccactgagcagacctggcagagtacctgagccttcatttatctcccagcactgtggctcttgcagaaataaaggttgggtattgatagtcaccccacccccaccccatagctcctgtactcccagcccacctgagttaggtgctctggtttgaggagatggaggtagggctcccagaacactccctgttgacagctcccctttcccatcagctgatgaacgcggtgaacacactggacagggacgtccttaaccaactgcacgtgcagctcatggagctaaggagctgtaaaggctacaagcagtgcaacccccggacccgcaacatggacctgggtgagttggcacgagtgcagcctgcagagaagagagtgtatgtcacgtctgccccaacgatgagcccagaatcacagggaagggtacagagaagctgtgcttccaggagttgagaagccacacaatctatacaggacactgacttctcttctctgtttcgctcccttttgttcattcattcttcatgaagaacttagcctcctgagttccttgggcagcaaatgtatgggcaaggtgtggagctcctcctggccaggacccatactgggaggcatctggcttgaacggagtgagacggggacccgcaatgcaatatgctgtgatcgttagctctgcgatagaacaggggcgaccactgtagaggaaacaactgtcaattgcagaggaaacatggagcgctgggaagtgggaggggcatgaagccatccagggtggctgcaacagaaagtgactgacctggcggccaggctctgtgggccagaaaggaaagtctagactccattgctttggagaaggatgctggaagggtttgcatttgggcagtgaaagtcaacattttaaaaagacagtgattattaagtagaagatgaagctggatccagtaaatagtgccacacactatggttatccagggagagcgtgctcagtaggagagatgatgccagacaggcacagtggggaagcccacatcacatggtgattcaagatggataacagaaaaggaggtggcatgggctgccccctgggtttgcggtgagcggggtaaaactggcacttctaagctcaggatgccagctagatgggggttttgttgttttttttttttttcaagatgggatctctttgtgtagccttgactgtcctgtaactcactctgtagaccaggttagcctcacgctcctagagatctacctgcctctgctttccaaatgctgggattaaaggtgtgtaccaacacacctggccagctagatgtcttaatggaggacatcatgctattagcctcagccagtatagagggaaccacaaaagccatggacatggaaggcctagggagacctgtctgtcctaagctgcctcctgttcctatcaggaaagtgggaagttgaggagacaggcccaggtgtgccagtctgccttgcaatggggggtgggggtgtcaaataaatgggccgagagtgactgcagaggagaaaagacaccacctgactctcaagtgctcctttgtgacagctgtggaatctcctataagtactgtgccaagcacaccgcgccaaatgatagtgtgtgggaattctcacgacagccctgaggtgactctatccccagcttaacagtgagtgaagtgaatccaccgggtgactccatacccgtgctcttggtcataccacccacagccagtgagccttgtgtggcactagtacccacaccagtgcctgcttccccttctccatcactaaggcgattgcgaatgaaggctcaatgtatacgatggctaactgggctcagcagggggcaacctgcaagtgcacctagcagactaaagggcttcattattccctctgagcaaggaaccccagcaacatccccgcactggcgttcagtaaactgaaggtggtcctcggctgtgtcttcgttagcgatcgcagatcgtgctgatgcttgcaccatttcgccctaaagcgttcttattctgttcttctctcacccagggcttagagacggaggaagctatgaacaatacaggtatttggggttgttcctaaagtctgggctaagatcccttatcttgacctgtcctgtttaaaggttgtagctattgagaaactgtctgtctagggcataatgaccatcagtgatagatgtcgtctcagacaccatctttacacagcccctttggagggaggaacaaagtgatttcctcaatggtgtttaacacgcattttccttttggcatctgaaaatgtaggcagtttcagcgtcgaaaatggccagaaatgaagagaccttcttccaaatcactgtgagttgaagaaccagtttgcagacgagcagagctggttctgacttgctagttttgttgctgctattgtctggttgttcttagtactggcattgaagccaggaattgatcatgctaagagctctacaccaaactccaccccagccttaagtgtctcctttccagggctgggtctatctttattaccctctcctcccctgctaagatggtataaagtcatagctgcttttcctataagataatgtgaatacatttcatatttcaaattaacgccaatcataagttgctgttctctctgtaagtctgggggcttgagctattatgtagcgctgagaagtactacaggtgacagacaccttgaaggatgtggctgcagaagcgctgacagggtgtgtccctctcagcagaatggctgtcaagggccatgtgcagactgcagcaacctgcacttgacctcatgtctaagggggttagggggtggggtggggagaagagccaatcgttccccaaggggtccaaattctttgccagattctctcaaaagagcagttcttttccttacggcctaagtactcctttgcatcagccacatccttgaggcaacgcttgcagtgtggggctgacttaaatccagataacactgtaatcacaggctgatgtgcactttgttctgcaggggacagctatgggaaggttgggaaggctaagcggccatagagagaggaacctccaaaaccaggggcctcgtgtggctgcccaggccatgcaaaaaacacccgattcccagaagatgaatgttggaactgggagacctgacagaaggcagggctgctcttgggacaggaaatcctggaggacagcgcctggactttccgatgctcagtttctttgccctgctttgctctggatcaaacctcactggctgctctgggatgcgtgctcacacctggagtctctgctcaccctttcagaggctcacaaagacaaaggaactaatttccatggacacttcctccagagatggaaattgctgggattcgcccactcctcccctgcacccctcccccagtcatctagggaagcaagcttgttttaaccttcttactctttggagaaagcacggacatcccaggtgctgtcaacctcacagtcttgacaaagtctatagcacaaaacagtaccattcaccaggctggttgacctggctggctcagaagctgccttcaccacatacatgaccgctcacacgtaaccaacacagggaattgtaggggaatctcactaatatgaaatcccgcttttcaagagtcgcggtgtcaataaacgctgtggctaggatcaaggataatcccttgagctttcagacatttattcctgcccgggattcgttcctttgttatccatcccagaactgatgtttttctaaggtaccgaaaccccaagttgatgtgtgtcctgtgttttaatgacattgtatttgtaaagttttgtagtataagtaccatcttacagtgttcctgcccccagccaatgtctagctattggtatgaaaaaaaaaatctttgaatttttgtaaaaggctatcttgggacttttttgctctttattattatcatttttttcttgaagcactcaagatgttgtcgaccttcagctgagggttggagaagcagagggtaatacattaatagtaaacctctccgattcaagggacctcataggtaagtctcaccagctttggggcatcgatctgtgaagcaaagcatccaactgcaccaaccctttgttcatccaggtagggtaacctggtcaatatggctgccagaaagcagctgtcagagcttcggaggtgggggtggaaatgtcagcccaacccgactcagcagagggggctcacatttctctaaaccagcagttttcaagctggggctccaacgaccctttcacaggggtccctaaggccatcagagagcacatttaaatgttacagttcacaacagtaacgaagtcacagctaagaagtagcaacagtagcagaccggtggctggggagccccacagtatgaggaacataattaaagggttgcagcaatagggatgctggagaaccactggtctaaactatcccacagttttccaggctcccaggagaacgaactgttccgacctcgcagacacagtgtcctcctcactccttatcccgctttcacccctgccctgggtgtggagagaggaaaagcatgcggaggcggaggcttaaatagaaacctttatttacaagagcatccagacagtcggcaaggcatccaaagctcacccaactgagtcaccgaatggtttccattccttgcggtgtaaagaatgacaccatcttaagtgacacttatataaatgtgattaaccccaaatgtgttctcagtggtgtcggtcagttcctgagaatttactgctcttggagtgacatttccgtcttcttcagaactccttattttcaaaagaagagaaaaagggaggaggcaagagaaaaacaaaacaccgccctgtttttaatcgcctgcactggaggtaaacacacctgttgcttcatggcagggccagattcgagctcacctagaggtctgctcctggtaacactctactgcagatagaaagggactggactggcgtgttgtaaactggaaactctctgcacagtccagctgcacctacccctgaatcaagccaattatgtgccctagtacccactgcctctggccccgacccacctcagcatctaatgctgatgaaccgggtaggcctgttaatgacaggggcacagtttagagagaaagcgttctgataccaacagcaacagtacagcttcatttatttttgaagaaacatgttgccttaatatcatttggatcttcataaaatacatttttatttatatatctttggattcagcaaaaaaaaaaaaaaaaaaaaaaaaaaggtaggtactggaaatgtccccacatcataaaagcagatgaaaagaatacttttataccatttgccccaaggacacctaggtttaaagaggggccagggaggagtggaggcgaggtaggcaagaagagtacaaagagaatgacccaaaaaagatttaaggacaattcaggtaaaaacaacaaattatctgagaggctattaaaaggaaatccgaattttgaactggcaccaataaaaatcagtaagtagaaaatataaaaacataataaacttcatttgtctccccatataaaaagggggtaccaaccagttggcctggagctggggtgctgagggcagaatcaaggtctctccaagttaagggaagagcaccactgtggcctacacctaagcatggcgggctcaccgcgcccagccagatcgggtgtcagcggcaaaacacagcacacaatggaaacgaggacagtgagctgatcatgaccaaagcacgttgagaagccaagtccatccacaggtgcttctggaaatgtgagcttcactcacagagagttcagagaatgaagctgtgctcccttggggggggggggggcggggggaggtggttgggggtggaggacaactggctaaacgtgtgactcttaaacattgactggatctcggacaatgacaccagggctggtggagaaacaaagctacagatggtttactaacctaatgccatctaactgtttgaacctaaggacccaaataaaggcattacacttggtttccctacttcacactgacgaggacaggtgccaagaggaggcagagaggtggcaggaggggctggcatgtgccaaggtgtcactctcactcagtggcactggcaggcctggttctgagctcagcaccctgatgcggagaggtagtaagagaccctatgagctgaaccagaggagaactgggcagacaccagaccacacacagcaagggcccggggcctttgacctaaatgtggggctcaggtcctagtaacagacatcgatcctaaaatgatgagtgggctacagttttccaaaattattatcatttaatttatggactgcttaaaaaacacaagattctttttaaaatcaatttgcttcggttttgtttttagactcttggcggttttctgttttcgtttaaagctcatttccccatatctattctttccccacaaattaacaaagtgcgtagttctctggtaaagaaaatttttaaaaaatttaaatgcctacatctaaacaaatgatccctttaaaaagcctttttaaagagtgaggcctgtaacacgaggggagctgcaggctgccctgccccaggctgggccttccagatgtctccgctgcctgtaacctcactgcgtggagcttacagaaatcaacaatgttaaatatttagcttcacaaactctgtaaaaatgagctgctgtggcctacaaaaaaggtatgtacatattttcacataatacaatatcttaaagatcctatttacaaagggaaggaagtgtgtccacagaagcactgctcgcttctgactcagagtgcaggacctggccttgggtttcacaagtttatttcaaagcattattgctccaccatataggcaaagggtgacgccagtacttgaaagaaacaacaaacaaacaaacgacaatcgtgttcttgtcctaacagattagtgcagacagaaagcaggaatgtggttcaccattcctcacgccctcaggaatattgcatttctccgtgacttcctcagtaaagtgcgcttggctgcacattggggcgggaaaattcaatattgccatctcatcttcccttcttcaaagccatttaacatcaatgacaaatccttgagaattacagggtacggggacctcaccaggagagacctaggacgacagactctggggactacacctgtaaaggacaagagcgcagaaacactgattgcactggacaggagagcgacacgaactacttgctgacgacacgcgagaaggcagactgtgccccctcgtccagtgctgcaagacagaaaccctagccatctagatctacgtgaagactttggctggcgaggcagaagggagtgacgtaagagagcggtgcttacgaacaccccatctccagaatcacatcctcatgaggcagaacaccttgccacacagaggcagggcatcaggtagacagtgcgcttcagcgagacccagctctgctcaaatgacagcacagaccccgctgctggtcacgctggccttgcttccaagctggatgcttagacaatgactcgccgccacgtcctgatgatcctgtgcagtgtcatctgtacagtcagtcccactagggagatgtcagcagtatttctgttaacagaagaacacagggtcagcgcagcagaaaatcggccactgtctgtacactcctgaatgcaccgccaaatgttttcaaaacactgcagtagtttgttctaagttatatacccaagttaaaatctccagaccactgtgacagttctgggaggcgtaagaatagatgcccgtacctgatcggggcccatgggcatgccagacatgggcatgggggtcatggccatctgtcccaagtgcccaccgctgctgttcatatgcaccatgttgtaggctgcagggttcccctggggagcaaactgctgctgggggaaggagctgcaaagaaagggtaacagtgttacttcttcagggaacacagactctcacagttctatcaaacatccctctacctgagcagaaaacacagacatctctgttgttgttgtttgagacagggtctctctatgtacctctggttgtggtctggagctcgctaagtagaccaggctggccttgaactcacagagatcctcctgcctttgcctcccaaatgttgggattaaaggcacagagcaccatgccctatctgagaaaagcttctggacagcctgcgctcacagacatggcacaatataaagcaaccacaaaacaagccatatgcctcagtttctaagagccaagcacatgatctctccatccagtaagtgtgactgagaaacaggttcccggattccccactaggatgtaaaagtaagtcccatccttacccattcctggccaggttccctgacggccaccccttcatatctgaaggctgatacatgggtgtgggctgaggatgctgcaccatggcattctgggaaggccccattcttgatgacatcattgcactgggaggactcgagcctcgaccaaaggctggctctggtggttgtcccattccttaaagaaatgaacagaaatcagtgttcaaatgcagcatccatggactttcagcatcctagaatcaccaaagatggagaaggaaggagaaaaaaggctccacgccgatgctctgtcgttcttgcttctcactaagatgacaaagtcatcaatttagtaaaaaaaaaaaaaaaaaaaaaaatgccatccagggcaccgtggcggggcagggctgcactctctaacaacacatctctgtcccaaaacctccccaaaggtgggcctgaagcaccgcctgcttaatataatcacagtaagtgcccaagtcacagaaaaaagggatggcgaagcccatactgggatctgcccctcaagcttgagtgtccagagatatcacatgggacatgaagaacaggcaagaggaaggtttatgtgatctttttcaaataaggggatgagggggtttgcaggggctaaaaaaaaaaaaaaaaaagtccagctatgggaacacacactccttgcttctgcagcacactccagcttcctgcagctccagacagttttcctggcaaacaagatggagtgagcggtacttttgttttcacactcaacggaactggtgcagcttggggccttactaaccctactttgataagggcacaatctgacaggtttaccgtaatttgctggatatggaaactgttgtggaggggcttgcggcattgctgaacctgccaaaaccccgtccatgctgggggaggcggtgacgttgggaggtgggctgaaggcctgaggctgtggttgtgacatcatcatcgccatcctctgctgctgcaggtgatggctcatcagctctcgtttctgctgggcagccatttgggcattaaagaaagcctgctggtagccaagagacacacaattaacttcatttcatagcatctcacaatacaccagctatggacaagaaagaacagagtgccctctctgtaactaaagggtagtatacacaagcggttctttacacccgtggcttccaaacgctgcccagtgagcgtccttcctgtgcagggtcagaggcagtcccagaatcccaaaacactaggcagttatcttacaacacagcagctcatcacaaagggaatcaatctgggtgagtttactgatggttgtaatcaagtagccacttctctccagcccctcatcacagacaaagcagagtgagagtgaaagaccaagtacaggagctggagacatggctcaattcccacacccacaaggctgctcacaaccatctgtacctccaggtccaggagatctcatgtccttttctggcctccacatgatacagacatccatgcagataacacactcataaacattaatatatatatatatatatatatatatatatatatacacacacacacacacatatatatacatacatatatatatatagagagagagacagtgtgacaaccaattcttacaaaaacttcagaattatttaacaggcatagctaaggccaggccgggcgtgggtcccgcctggactggccccttctctgcagggaacgtacctggggcatcatgggcctcatcacagcagtgccagcagggttctccattttcatttcaagtgcctgccggctctgatttaaaaactgaacagagttgggttagtaggtcaagtggagcgtgttagtgagccccaatcagctttatacactacccccacccagtgagatctctccagacccaccaagctagggagccacatttaaactgaattggttcgtcgtcgtttacatcctgcagaaggaagacagctctacagctgagagcgtgcacagtccatccactggaccagattcctttcccagcacctacatggtggctcagtcaccactgccccagttctagtgcacctcacacctctggcctctgcaggcgtgcatgcgtgcgtgcgtgcgtgcgtgcgtgcgcgcgcaaacacgaactgcacagacactattaaaaatacaagaaaccttaaaaaaaaaaaaaaaatagaaaaaaagttcgcaggacagagttcctggacagcgacattggcgccgattccctgcctcggtgtgaggcttaaacaactgcagcaggaatgcagtgtcaagtttctccagggactgttgctcagacaatcaaaattactctgacttgatcagacactagtgagcacttaatagaaaggaggactaagctataaaatagtaccatgcgcacaggcacagagcttccccagttctgagcctgctgcaggggctgccatagcctggctctggcttcctgggctctcctactcaggtgactcactgccacctggtaacaagcactcaccagcccgtgcaaccatacaaatatgctttaaagcaactgcagattaaggaaagaggagggtgtggattccctagaactgaggttagacagtcagttgcccacagtaggtgccaggaactgaacacgggtcctctgcaagagcaacaagtgttcttaaccactgagcatgcctccggccccaaagtgcatcaagaagtgatttccattaaaatactgagtcaacaggggtgcttaacgcattgcatgcctgcaatcccggcaggagaggttgagacagaagtggttacaagtcccctagacaatcatcaagatcttgtctttaaaacaaaaagctgaggaaatgccttccaagggccatcaagacacactgctcctcctgctgtcctgtcctgtgtcaaacagctcactgtgctgtcctaactggcctggaactcactctgtagaccaggctgacccatggaactcacagagacctgtgcttctttctgcctctcaagtgctaggattaacagcatgcactaagcaaggctctaagaattaaactggcttgcctggcttgcttggaaagtacatttacccactgagccattttgccactgctaatgttatagcaaagaatatacatatagaaagatacccaagtttaatacacactccttatcaaggaactgtctgcataaacaaaatcttacagagaagtgaaagcaaaagggattcctttagttagcaaagagtggagagccggtggcaagggccacggagagcacagcctaagagcccctgacagcccggtcttacctgctggccctgtagcctctgctgaagctgcattctcagctgcttcggggtgttggtccttggtctcacgaggccggctctaggatgcatgccttgcagaggaaagctgccttgctggctaatctgacccatcatagagttaaacgatggtgactgtccctgaaggttaaagcctccttgaaggggaggaccctgagctgggtatgtctgtccatatagtgcagccttctgatccatcattactgctgcttcttggccttggaaaacatcctgtttggactccaaagcttgtcccttaaacatcaaacacaaaggaatggttagctacacctgagaaagcaaccaaaagcaaatgctgcaaacaagggaaaaaatgtaaatcagtacatgtgaccggtggtggctcagaacccagatgcctgaagctgcatctgcactgtgtcttgtgtactcctgtgtagttcagaactcatgtctgtagaatgggacaaccaagtctcaaaaggatgggagaaaatgaatggtgatttggttgaaatgtagtaatgaatgtaggtaattagattctctggttttcaaacatcaaaagaaaaccagtgtagggctggtgagatggctcagtgggtaagagcgcccgactgctcttccaaaggtcaggagctcaaatcccagcaaccacatggtggctcacaaccatccgtaacgaaatctgactccctcttctggagtgtctgaggacagctacagtgtacttagatataataaataaataaatctttaaaaaaaaaaaaacaaaagaaaaccagtgtattattttaatgtttaataataaataactctatatagtggaactgacataaattatgggttgtccaggtggctaaacaagtaaaggtgcctgctgcctgagttcaatccgtggctcccacacagtggaataataaactcctggaagtggtcctctgactccacatgcatagcagggtcttttaagtgcatgtatacatgtacgctctcggcctttttggtagctataatgtgtttaatacctgaaaagatactattggctcaaaaccagagctctatacactaagaacccttacttacacacttacacacacacacacacacacacacttacacacacacacacacacacacacacacacacacacacacactttaggactggtgaaatgactcagtgccactcgatgcctctgccacaaatgctgacagttgactcccagaggtggtcctctgagctccatgtctgtaatgtgcatgcaatctgcacagacacacacaaaataaagtgtaataaaactttacaaatctgttgttctcccataatttgtgaatagcaagagatgatttaggtaataataggtcagccaggaaaagcacctctgcagatctccatctctgagtgcactccccagttagacactaaaggtggtcactcaccactgatcctcaacaggtctacttggcaacagatggcatgttccaaaggaaatgtcgggtgcactgtgcacctctgccttctcccaggcccccaaaccaagaacacagtgagcagcctgtcctgcaattctgctctgccacctatgctctcccactgcagccttcccttgcttgggtaagggtcgagtgtacactgaagttccttctcaggttttcctcttctctcacagtgtttcctgtctgggtacgctcagacacagaggataactagctatcaaattatgcgttctacccgaaacatttctgaactcacttggcttatgcaaatgaatctgggtgtccccagcactcaaacttagtctgcagagtagaaatcacgaatttacaattctcccacttccccactagatagaaaagccgctttcctccaatctccccaggactccttcctcccgcctcctcactactcctcactatccttctagtctacgaggcccactcccaggacccttcccatgattcctgtggacccttgcagtgacgggtatttatgcttctactatcttatcattccaacctgctcacaccagatacaacatctttgataaagcagttatatgttacgttgaacacgcaaactatatgtgtgggacagtgaagggcagcctgttttggttgagcttgctcaggtgacccagtagagggagggaacagtgagccacgttcccagagacaggtgcctgacaccacagagcccccagctccataattctgtgacaatcagtcacgcaaacaaagccccaagctcctggcattctagctagactccaccctcacagttacctgacattagccaggagtgcttctccccacagctaccctgcaactacaagatcaaggggctgcttggtccctcctctctcttaagctctcacctttcttactcacccgcatccgcaacggaactctggtgggatgcaggttctctcccactccctatattcccccacacccacggccctacaacatgcattcatctcccttctcttgggcagactactaaaatgaatgtaaagaattcagaaggttctgagacccaacctaacccacagtataagcagaatttagccagatatccgagacttccatgcagccgctgctggccactcacagtagaccatgtcaccagtccccgggctatttattcagcatgttctacacttcctgtctggatcacagacatcatcctacctactgtgctgacaattcccgtaacactttcaccttactttctctgttgtggcatgtgcacatgtggaggtcagaggacagctttgtgaagctacttctcgaattccactttcatggagaccttgacgcgtcgtggtgccagtttgggccagcccacagaacagtacttgctagactatctgatcactgtgtcgcttgtcacctatggctgtctttatagatgtcttagataccatttaatgcttcccagttaacaacctcgcttctgagatttcaccagcattttactgttataataaattactgtgggtattaaacacaattttgaaatttttgatggtgtgtgtgtgtgtgtgtgtgtgtgtgtgtgtgtgtgtgtgtgtgtttgggcgtggggagtctgttttatttttcaagacaggatttttctatgtagccccggatgtcctagaaccttgtagacccggatagcctggaactcaagggagcagcctcctcattgctgaagctgaagctgtgccccaccatgcccggcaacactcttaagctggaaataaagctaaagccaagccatgacaaagaaggaaggagcagcaaacgctcacagtgggcattgcccagcatctgagtgtcacgctacaaatggccagcctggtaacatcaacactgcaaagactcggcatgagctctgcaccttcatgaaaccagacagctcagcctgaaccgccatgccagctgagcctgaactcgctcacatagcaagaaaatcaaaaccccattagaaaactctagagcacagatgcgtggccagcaaacaagcttgcaagaaagtatagtgagagccagtctatcatattagtaaatatctttttaaataaacacgctctgttatttgtgtggtcatatgcctaagccacacaatggagctgagagagaaaaaactgaaactactcatctagaaaaacaacaaatgccattttcctttctgtgacaaggtcctgatgtgatagaccagctatccagttacaaggtcattataagttcatttctgttttctgtaaaactttggtttaaccatgtcttgacccattttctggaatttgacatgttccacaccctatcccctaaccttcaccctaataagatgctctgccaaataattttgagtgttctgccaagttcctacagaatgaaaaccccttgagagccccctagacttgaagttttgaggctctctcataaaccctaccttctcctacgtccaatgctgttttctcaagccctgctttagagaaataacactgtctggaagaaaatagagcttgcttcatttgaccaaagattctgagtaatggctcttactctcacttggtctacagagttccaagacagccaggaggctacacagagaagaaatcctgtctttcctgaaaaacaaaataaacttgtaaaagtgtattttcatgagatgagtatacaaagaggcaagagatgacaatgacctaatttgccactgtaaacatgtttacccatggcctgcctcaccagcacactgggcacacctaacaggttggctacagactgaagaaaaagttataaaagtaagcagcatttggtggggctaagagaaggccacctcttatttatttcatgtatgagtgcaattatagctgtcttcagacacaccagaagagggcatcagatcccattacagatgattgtgagccaccatgtggttgctgggaattgaattcaggacctctggaagagcagtcagtgctcttagccactgagtcatctctccagcccaagagagggctcttgacaaggaccctgttccaggtcccagaacacacattttagctcagaaccatctttaaatccagccccaagtgagctaatacccttttctaacatctgcaggtaccaagcacacacatacgcacataagcaaaacacatacataataaagtcaaattaataaatctaattttttttaaagttaggtaattattattagggccagagatgtgggtgctagggtctgttcctagaactatatggtagctctcagccatctgtaatttcagtcccaaagaatccaaaactctcttctggcctatgtgggcacaaaaatgtacatagtgcacagatgtaccagatgtacatacaaacaaatatccattatcataaagttaaactaaaaaatttaagtaagcagcattcttaaaactagtgttttcattagatgttttctttggctgtagtaaaacaagggacaaatactcacactttctcacaagtgacacaaaggtacacagtctaaatttaagctgtgtttgtctccatgaatatgaagacatactcactgccacgctcttcagctctcacagactgcaactcacctgattcacgagctcaggaattcccaaggccctgtcgatctcctccagacctgtggcatctgtgttgctcaggagtgtgtgcagctggtccagcagagctctctcgtcactctggccctctgcgttagaaggtggcccaagcagatcatccagagagtttctaagaagaggcctagagagagacgtgagtcagctccaatgcagcttggttagagttggtgaggtcctatgttctacaccaaggaccacaaaaaaaccaaaccagtgctcttctgatgaagagcttgttaggcttttaagttttctgagagtctagcctcaaactcacacccaccagtctctcctatttagtggtaaatgctgatggtaatacaatgcccacaatgacactgaagtatgcactatgagatgtatgtgtttcagctgacctctagcctctgcataaacacagaatttttaaaaagaagacatggctgggatatttctcagaggtagtttattaaacaaattaaagctaaaatgtagaataaactcccagtctttttctttcattaaaaaaaaaagtaaaagatagtacaatagttcactcccatctgtactactgaaatgttgtagatgattttaaaagataatggagagatggctcagcagttgtgagtagagcaagcacaagaaggcccaagatgcactccagtcggggacctggcgccctcttctggcctccttggacactgcacaaatgtgatgcacagtcatacatgaagtcaaacactcaacccccgccccgcccccccccaaaaaaaaaactgaggcacagtatctgaatagccccccatggcaggtctgggtaaagtggcactgtaatcggctccatgagaacatgtctttcccaactgctactaatgcatgggagattactgctaagaagccttttggaagtcttgaaggctgaactgtagttctgcctcctcccaccctccagatgcctctgcttcctgcaccagcagatggcaaagtcaacagtctctccatactctcccagggttgctcctgcccacactcttaaatccagtgcaagcattcccacatcccaaaataaaaccctacctattttgagacccgtgaggaccttgttccatagagagcatgccctctggccaggaacctggttggttagacggcactgctgggctatagggattgactcccattcccatgggaatctcaccagttcctgggggagcaaatcaaaattttcagccaggtggtggcacacacctttaattccaacactcacaaggcagaggcaggtggatctctgagttctcaaggtcagcctggtctacagagtgaatttcaggtcagccagtgctacacagagaaaccctgtgttcaaccctgcccctatgccgaaaaaggggatttccattttttattgaaagggacagcttactcatttgaagcatctgctgctgttgctgctgctgctgttgctgctgctgttgctgctgttgttgttgctgttgctgctgttgctgctgctgttgctgcaacgatggtcttgcacctggcagtcgattagaacgaagtggcaaggtaggcacagagccccccatggcaggtctgggtaaagtggcactgtaatcggctccagttcttcccaggggacttgatgccagaggctccattctgctggcccttgagttagctaagccccagtctccgggggaggaagtcggattcacaggaacatttctgtttgggcctaaaattagggagggctcatcaggtctgacccagcacatcacacaaaagcccttcgtgcactgggagaaccattatttactacagtagccaggactgtcaccctgagagtagggctgtcacctacaaagacagtatctagaagcctctactctcacgtatttgttacaggttagaaaggtgttctgaaccaacgggatatttaaaagacaccatggttcaatggaaggagcactatattaaaaatatagtaataataacttaaaatattaaggctgttacttgagttccatgtttaaggaaatgaccacacttagacatgacctacccatgttggcaccgtaattctcctgactatccatcattcttggattcccagccagtatgggctgttttggtaacccagggaaagcactgacattcttcactggcggacctgagccaacagacacagggctatccagagacaccgctcggttatatggaggacgaacagactgcacaggctgtggacttcgcaaacctgttgaaaacacagaagcttgccacattagtataatcaagggcaactatcaaacactaagccccctacaaaaagcctttctcataaaaacaaacactaccattttcttctacaaaataaatatttatgtcaaaaagaaaagaaaaaacccaaattccaaataaagtacaaacaaaagtctgtatgttggccaaagtgctagctagcattcagctgtagccgaatacggtcatgtccaatgcctatctcagaatgccacggcaaggctgagcactgaggctcagtaggccatgttgaaggagcatgagactctgaatgcagatgcccaacaacacaaaggaaggagggagatggagacagaaaatggacagatgcttttaattcctagagatgcttccacgtacgcacttatgaagtagattctctacttacaattttacaataaaaacaaaaagttaagctgccttccaatcaaataagtgcacagtttcttcccaacctctttgactaatctgaccagtcagtttaggaaacagtaaaactgaaggtaatgagaccctgttgcaaaaaaatggagggagggagggggggagggagggaaggaaggaaggaaggaaggaattaagtaagtgtggaggccatgcctttagtccagcactcagaaggcagaggcaaatgaatcttggtgatttcaaggccagggttaccctttctcaaagaaagagaggggaggagaggagtctgatgcaaaagatagaaagaaacaaagaagggggagagaagggttcctgcaaagaccaaaacaatgagaagaggcacctctcagggttaaatacaaggaccttctttaaggaccaaaaatgacatatttaatccagtttgggtcatttaacccaattctccatgtttaagaagaagtctaccccaaggcccaggtatgtgttctctaagaatcataattactgagccggggctggtgagatggctcagtgggtaagagcacccgactgctcttccgaaggtccagagttcaaatcccagcaaccacatggtggctcacaaccatctgtaacgagatctagcgccctcttctgcagtgactgaagacagctacagtgtacttagatataataaataaataaatcttgaaaataaagaacgtcttgtttccaaaagtattatacttaatttaaaaaaaaaaaaaaaaataaataattactgagccgggcatggtgatcccagcacttggaggcagaggccagcctggcctccagctgcttcctggtcgtggtggaagcgaacatgcgactgtaccgagtgaggagcacctgcattgggacgtctgtctctgagcaacctcggctcctcacaaagccccacccaacctcacctttcaaaaaagaaaaactctggttttccttacccagagaactcggtcctgcaaacatctgctgtttggcccctgggtgaccgccatttgtaggattgttgtagaagtcagaactggtcaaatctccaagaatggcatctagattatccaggtctcccgatacctgaaaatgaaccttttaaattattctgtatgtaacaccagatgcagctatcaaggcatcagccaaaaaaaaaaaaaaaaaagaacgactggtagtgcgcacattgaatcccagcaaactaagttccgggacagccagagacagacagtgagactctccctttccaaagaaaacagaccaacaacaaagcaagcaaacaaacaaaaacaaaaataagggttggggatttagctcagtggtagagtgattgcctagcaagcaagcacaaggccctgagttctgtcctcagctctggaaaaacaaacaaacccaagcagcaacccacaagccattaccagagataacaatgaccaggacagaggctgctgtcttgggacacacacatacacacacacacacacactatctccaccttcactgcaaggatagccatttcgataaatccctgggctctgctggcccacactgcactttttgctctgccactatttcccaggacaagtggctagggaggattcatccttagctggcagaaacctccacctatgagtaacttttctgaaaatgtattggtaagtggtgtttaacaaggtattcacaggcacacagcaagggacccagcttggatatggtgaagagaggtctgtgccctatcctatgaaacactagtctttcttgttcttgctagaagagtgcttactcttagtaagatgcatttgtacaacatgcaatatgcatgaaaaaggtgctcgctctctctctctctctctccctctctctctctctctttcgtttttcaagacaggctttctctatatatatagccctggctgtcttagaactctcactctgtagaccaagctggccttgaactcagaaatccacctgcctctgcctcccaagtgctgggatcaaaggcgtgtgccaccactgccaggcgaactctcactcttgaggggggggaaatgatgctgataaattcaaacttttcccaataacatctaccatgtccttaacaacctaaactgcttattccaacgtagccacttccatgaaaatacttctaactggccactaaaaacttatttatagggccagtagaatggttcagcatgtaaagatctttgcagagcaaacatgacatcttgagttcaaccttcagtcccaccaccccctcacacacacaaactgtctgtctgtctgtctgtctgtctctctctctctctcaaacacacacatacacacacacacacacacattctctctcgcgcacacacacacactcaaactatacacagtaactatatagtgaatgaaacctcaaggttatccttcaattaaaaactaaccatttatgttagttattaacaattgtaatgtataacaaggcaatgtttataacacagaaatgaagaaaccaatgaagggctggaacagagagtaccttacctcctcgttcgtctcggtcttaattttggggtctttctcttggccagagctgggattggtggagcagctgcactgactcagtttactgtccccactgtcggcctggggctgcagctctttggcaagcacatcactggggtcatccctgtccagcaggtatctaagcagagcattattctccttcttcttaggactcagctgctcctgcctggttgtcccctctccacaggaagcagtgctgctcgtgtccttcccagtggcctctgcagtgatcttggcgacctccgctggggagttgccattctgcagcaacttgtgcaaaatccggtgtttctcttgcaacagagacccatgcacattggaggtggaagacactgtccctgatgttgaggaggacactccagaggggctggtgacactaacggaagagtctttgcagtttggatccaggggagagttggtcaaggaggaatggcctcggtcgtcggaggagcacgtgagtaactgcagcagtttcttgtggcctttgctttccagaggtcccctgggcgtctctgacacctccccactgctctccttgctttctttttcacttgggtgatctctgctgtttgactgacacactgaactctccactggattctgttcacagtataagcctagggggctcttagagtcctgaccactcactttacttggctggcttatattcatattgggagaattatccagtttggggcctggtgaggacagagtagataaaagagaggtccccacgccttcactgatggcttgcaaggcactgagggagctgctagaaaagctgtggctccctgtgttgccagaaggtcccatgggtgagtgtgcacctgcatatggagaaaggtcgtgagagatggtcagacacaacctcttttcctattaccaaagacactggtgaggaaagaaaagagaagcaaaggaaaacgcagctgtggatacctgcagcaggagagaactggtgggaggccatctttgggctgccacgattccgaggggaaatcatgatgttctgctggttgggaccaagaccaggactgccgtgggggggactgctcatgctgagcccatagctgctgttctgataggaagatggcgactgtaggctttgtcctggcgtcagtgaggctacgctactagaagccccgtacctagctccacccatctgccctgtgttgctggggtctggcacgccataggtccggctgcccatcatctgtacattctgatttggagacatgctcacgccacaccctgctgcaggaggtcggatgccttgtcctgcgggatttgggtttggtctgtatccattctgttctctgcaaacaaacacacgcaagttttcctttaaaagccagcaagggaaggaagagagcgggaaggagctgtccaggagcagacactaggcgtcactccagtaccaagtgggaaacccaattctggggctacaccaagccaacccagcaatactctgccttgcttttctagcttatagacatatttcgtgtacactggtattttgtctgtgtgtgtgtgtgtgtgtgtgtgtttgccatatgcatgcctactgtttgtgggggtcagaaggcggcattggatcccctggaatcagagttagagagttgtaggtcagcgtatgggtgctatgactcaggtcttaagaacaggtgtccttagtaactgagccatttctctagcccctccttttcctgttttgatatactggggatgcggagtctcctgcacgctaagcaagctctccagtactgagctctactccaaagcccattgatattttgagacagggtctcatctcacaaagttaccgagtctggtcttgaactcattcattaactcagccaggcccagaacttgaggtcctgctgctgcctcagcctcccatgtagctagggtaacaggtcacaccaccagatgtcaaatatggtatttgtttgttttggtttttttttttttggttggttgctgtttatttgtttgttctttgttttgagatgagcttcgaagtcactatgaagattttttttgcctctatctctcaagtcctggggaaaaaccacaggagtttttcccaaactcagtttatactgtgctgggaactgaacctggggcatcatgcaaggaaggtattttaccagctaagctgcatccctaacagtttagatgagccacaagatctaaatgagtgacatcagtgctgagtggctctgacagacatgtgctatggagcctccaaggcctcattacagccgaccatatctggggcttggccttaagacagtcaatgaatgaacctcttcctatgcagtttgttcaccattagtaacatcagtaattactaccttttagtagctagtaattacatttgtattctaccttctattcaaactccagtccctggaagcaatgtaaatgtaacactagaagtgaaaggtaacaagtccactactctcccatccaccaccctcacctcagcccccccacacacacataccctggccttaatcgggaagcagttatttagtagaaaatactaatttttaaataaaaatataaccttaaagaaaacatactcttaagaacctaaattcacttcacgaaatccaacagcttccctgacttttctccctgcaaatcaaccgcaaagcatcgtggggacaagggtgctttagtgtcatcacctctgaagaaagtgggtcgagatgaagccgtgacgatcattcgttacaggattgcggaagagtttgctttttgtctgcgcactcacaatagttccatcagccaaggagaaacgatacacgggggtctctgcgtggccatgaacataagctacggagggggaagcacactgtcactagcatctgagactagaccaaggcagacaggaacagacgaggaggaatcacgcttcgagtacaaaattgtgttaaattacgcggaaatacacaaaagtatagaacagctacgctcagaaaccactccctctcccacaaccaccaaagagcaggacgaggactgagcacacagtgagtgctttacagcaccatcaacatcagcaccaagatccaccccaaacgcctccctcaccttcttgatagtgacgcttctgggaccatgactgcccatcattcagactgaagaacctctggatacatcttcggattatgtcttcaaagccaggcctcatggaagatctaagtgagtttgtatctatattgacaacctttcctattaaagataaaaacagaagattctaaccctgtccagaagagcctactgctgcttaactgactcgcatttgagaatgacataaaggagacaatctcagctctgccttctgtccttcacacacagctggtggctgctctcctactagctgtaagcaaagctccttgtaagaagcacgcctctgcacccctctgcaccggatgagccttttataatgcgctggtgctaggaagggtatttgactatacttagcgtttacttagaggagaaaataagactgccaaatcagagagacacagaaagtgagagagcaaacactcaagaagaggctgattccgacagatcacgtaacaaatagaaatgtatgtctggagctacagagagccagattcactctgagcacacaggaggagacctaggtggcgaggcccagcgtgtaagaccgggctgagaaatggagctcagcgtgtaaggtgcttgctgaggacctctgttccatgccaggagccccaggtggaagaagagtgaccttgtcaaaagtgcacacacttgtgaactcacagaaccagcagtgcacacactcatgcacacgcagaaccagaggaataagaacactttataacgtttcccagtgaagactggtcttaccggaaaggtcatgtctggtaataaagctctcaggactggatgggaatggcgcagtcacgcggcgagccacgcagatcatacagcactgcaagtctacaacgaaaggtcaccaggtcggattacagtggctttagctgtgactaacgggcgagcaggaatacaacatcagtaagaaaggttaggatcagcacagtggacccgcctctcaccttctccttcttccagcatagcgcgaggctgagacagggcaaagcactgcattgtttcatatctctggcgtgtttcgggactggcattcacgtcttccaaaatgtcgtgtgttttcatcaacatacgacaattaaatgtatggcttttttgtctctggttctcattagtccaagaaactccattaactttgaaaaacaaattaaaatttgaaaacaaattgaaattattctttataaatcaagtaaagctctgtcaaaattaattaaaagagttcaagctagcgttgggccttgctctttgcggaggacctgggtttagttcccaggtggtacagtcatccacaactccagttgcacggaatctaatgcactcggctggcctttggtgcacacctcatgcacatacatgcatgcaagcaaacttttcattatatatacagaatttttaaaaattcaagctaggggctgcaagggcggctcactggttaagagcacttagttggctcttcccgaggaccagagtcaggcagctcataagcaccttcaactcctgcttcagataatgtcctcttctggcccccatgacactgcagtaacacatggcatacattcacattcatacatacatgtaagggttttcatatatatatgtaaaatcttttagaactcatgctataaagtgagtgtggcagggcaagctgctggcccagctactaaaggggctgaaaaagaggactgtggcacaccctggggcaatacatgagaccttacctagagcagaagaacagggtccagctatcttttcttactacacaacacccatgtggtgacacctaacatttcagaatgacagtatcaagatatctgagtaagttcagcctcatcaaaagtctactgaacatttgggcaccatggaaaacttttgagtacactgaagccaaactgaaaattttgctggcaatcacttattaagtctcattttctggcttcctagaaagcacatccaatctctgaagaaataactaagaaaaattaaatatatatctagaaaacatgtttatatgcaagcctgtagtcaggcatggcagcacatacctataatcccagcaatgtgagacaagacaaaaatagatgatcatagattcaaagctagtctggaccacacagtagggtaggaccacagattcaaagctagcctggaccacacagtaggaccctgtctttccttgagaaaaccaaacacaaagaagagcccacctgtggattttggtaagtgtttaagaaaatccttccggtcttgctcatgtaagatgctgtagacacttgtgttaaccaggtcctcctgcttgtactgcagatactgtgtgacattttctgacacgaatacaatgtttccatctcgattcaccacaaacaggaaaccatccagtgcctacagtggaatgtgttaataatattatgaaaatcataaccccacaaaagcattaaaccccctcccccccatttttgccagggtttgggttagggttcaggttagggttatactggcaaaatagagcatttaaagggtcaatagtattaaagaggaccctatccaatacaactggtatccttataaggacagattaaaaatacacaggggaggcatgctcagggaaaaaggccttattaagacacatagcgagccaaggagagaggactcaggagaaagcaaccctgccaacaccctcatcttgggctccagtcttcaaaactgaagaaataggcttctgttgtctgagtcatctactctgtgacattgtcagtgcagccttagcagaggaaggctacagcctcgtttgtaagaaaatctgaggggggggagaagagagacacactagcccaacatttagagttaactgttctactaacattagcatatttcagagcatacaaaaatgtttaaaactaggcaagtagggaatgacatattatacacctttcaccccaacatttaggaagtggaggcaggaattgaggtcaccctgatctatactgcaagttgaaagacagcctgtgctaacattacaacgtctcaaaacaaaacaacaaaaaaagcctgtatgttttgggaccttaagaaacaaagaaaaaaccaaaaaaacaacccattcttaatgctgcccaatttcccacctgacctcaagttaagccgcaggattcctatctgctcctgaacaagagcttaaaaggatgaacacaaagtagtcgaaatgactcactgaaagaaagaccagatgtcaagtaaacttgctgaagcgctctccggcctgaagtagacactgcgccatggttaatcagctcttcccaaggcaattactttaaaaacatgcacatgtttaatgtttgaaattgcctcacaagctggagtgtagctctatcacagagcacatgcctagcatgcatgaggccctgggcttccctccccagcaccataaataaattctccaggaattcagagccgagggcggaggatgtcactccgtgctaacatgcttgcctactatggtcacctagtatgtgtgaggccctgggtttaatttcaagcacagcaaagaaagagtaaaactgtagtgtactatgcaagcattcatgggaaaattcatagaaaggtctgaactaaaatgcactaagtagcacctctacgcgttactgactctatctcaaagagtgtctttgcttttgtgtacatgtgttgtgtttttgtgttgtacacagtgcatatacagtattatatatagtgtcaggagggtattttatgagtgctataatactgagctctgctccacgggggtagaaactatctcctcatttccaatctcccctgcccccacacacataaatcacagagtacaacaaccaaagcatgacatgctttggacagccacaatcctcacacctacctgtagtaaaagcggtcctaaagagtctttatcaatgactccctgccctgtagaagacacatcagctttttgaacatcatcatcactggaaatagtttttcctgaagacacagaaggaagcgtcgtgttgagcagcactacctcagcccttacacacacacacacacacacacacacacacacacacacacacacacacgagagagagagagagagagagagagagagagagagagagacagacagacagacagacagtatgtacatatacatgcagaacactcactagctgataagagaaggcctcaaggtttcccaggaaggtagaagacacctggctggctcccttcctgctcccatgctagcctaagggccctagcttgcctcccaccagcattccgcgttctgaagaacatcggtcttctgccaattctgttaattgtttcttaaaagtaagagctggtcaactcatgggactttggtaagtcttacttaacacaagtgaggctctatttaatctccttgatccagaatgggggagggaggatttcatacatattacaagtccaacacttgggtgtttttctgactctgtgttaccttgttcttttatttgccgtatctgtctcactgtctcctttaggatggcacatttatctggcttgacattgaagttgtcgatgtcgctgagatttgcagagatgagctctgccagctcctctatgtacttgctctcctgctcccgtcgccacttctcaccactgtagacaagcctggaaggcggagaaaagccacaacttacacctctcaagaaaacttaaagcagaatccgccccatattatgcattagttttgtgtgaaataaactaaacttagccaacaagaaccatcaaagtggtggcacaaagtatacactgaagaaattccttgttcagtgtcacctttgattagtccctggccttgagaaacatctggaaatggagatgatcacctacccctgtcctggggcatcacagggcagtttgcgtttccgagactcagcggccagcggatccaaagagctttcgcctagtccactcatcctgatcacagatcagcaactgcggaagaagaggtgacaagattaaagcacaaaaacaggcattttctacgaaggtgtcacatggtggaacagctgtatcctgtggtcctggggtatttctgtatgaatgagtgtgtctgcacaagctcagagctcagatgcgttgtaattatgctgggcatggtggtgccagcctctaaccccagcactcagaaggctgagtcaggaacattaaggattctggttaagcctggtctacaaagcaagttccaggccaatctgggcccagtgtcaacttatatttcacaaataaattatgtttaataaaagactatagcacttcaatcttgaaacaattctgaattttatttataccaaggtaataaaagctaacccagtgatttggtaagaacacttcaagtaatgagcccagactaggctagaagattggttttgactttctgtatatgagtgagtgtttgcctacatgtatatatacatatgtatgtgtgtgtgtgtgtgtatatatatatagctagcatgtgtatgcagtgtccccacaagccacaaaaagtcgctgtcaatcccctggagctagagttaagaggcagtcatgatctaccatgtgggcatgttgggaacagaactcatcctcctgtccccaggctcttttcctaggtagcacttctgtccactggatcgtttctcttccattgttaagtccaagttagcctagactatattaacatgactgtagaactaccctacgttcttcttaaagcataggtgcaaagccagatacacactatacgacaggttgccattaagtcacacagcagccattatttacatactgacggctggaaaaataatgtatcttggttaagtttcgcacactaagacgataaatacaagttatttctttttgagcttataatgtcagggctctattcagcctcatttactaactaagtggttaactcgtgcgcgaacatgacaatcactggtctaaagaatccaatgttgcatcagtattgcagccagccagcctgcagttgtgccactaggtggcacaattccaccacaaaggccagtttaaaaataaaaataaaatgtaaaaaaccccacatgatcaaacttaaaatatgtaggtcatgtttgttttgagacagggcctcattgcccagactggcctggaacccatagttgtggttggccctgagcaccaatcctcctgcctctgcttcatactgagcaacaagtatttgccgtcctatctgtggtcacacacaccttttgaaccctctacagtgtcagactacagcatcatgtagacagacaaagtgttaaacagacaagtgtggttctagctgtgttgtcaatcagttcagagattatttttttaactgagcaacattgagcgcttacatacctatctttacttaacttattccagaagtctaacattatcttcttgcccttgtgctacatggactgcaagtccacgtggagaaccgtcagtgaagagcagttcatggtttgatctgtactccacaacaggtctgactttgctgtgcaatacagcatacagcaggaaatgaacatcagtggagtggtgccaactcaatgtaactgaatacacaaagactggcagtggctccctctaaaaacattaaaatgctggttacggcttaccgttaaccagcttcctttttgttatctcagggttctgacaggagaacatgcttgctaactagcccgaagcacaaggacacatggccaaaaagaagaattagtgagaggcctcagagggcagaggcactctcttgcctctttcctggcaaccagagatccatcctggggcccacaagctagaaggaaagaaccatgttttctgtacaatgtttgtagactgagacctgtgtgcatgcacaggcacacaaacgtttaaaaaaagattaaacaaaaaatatcaatgctggtgttctgtttgagcaagttattttaaggtctaagaaaaaccttattgtaccaaaatgagaggaggtaggccatccaaggataaggcagcagagactggttaagccttccccttttcctaacttagttagtaacagagggagtggatgagacagagcagaatggcactgaactaacatacactgggtggttacacatggtgacccccaccacacacatgtgattagttctgttctacagatagggaagtggctaaatagcttgcctagaatcattactagatccggatggaagaggctatgacatattccataaccaaccaagccatcaccagagcaaacgattcatgactcattccctaagtcaaactccctccacccagctcacaaagcttcacagcttaatcaggaaccacataaagtgctgtaacatctgctggttaggggcatgaggtaagggtctgggcaggtaggggttacctccacaggcattatgcctcctcctacccaccactccccatgacactgcctgaaccatgctctgccaggcctgataccaccctgtcttccacatgactgtttgtgtcttctctaattaatctttgtctcaaagaggcacatttttcaaagtacctctggtttcctgcaagtgacaatcagacctcaatcctatcaaggactgtccaggctgcaccactgaagagcacggcctgacttcactgtactacaaaaacatgtgcacatataaactgtcagtgagggccagcactggataaagctggcctttccaattagatgtgtttactttcaaatagataacatttcattagaagtctttttgtttgtttgttttttcccccaagacagggtttctctgtgtagccctggctgtcctagaattccctctgtagactgtagactagggtggccttgaactcacagaaatctgcctgcccccacagcctggttcattatatctttttaaatctacattcattcacagcaccaatcattcatcagagaagacatttagtaatgaatcaaattcaccaatatcatgttcaaatgttatcattggccatcagacttcacctccaaagagcgagtttaccttatcactttcaaaacattgtctgccaaatatacaaacttgaaacccatagattgtcagtcactgattcaattaaaaatagtattttgaggctggagagatggctcatcagttaagagtacttaacgtctgctcttctaggtatcctgagctcaattcccaacaaccacatagtgcctcacaacctatactgggatctgacatcctcttttggcatacatgtatatagaacattcatatacataaaataagtcttaaagaatttctgaggactcaaaaactaaaatagtatttcaaaccaggaatggtggtgtgtaccttcaatcccagcacttggaaggcagaggcaggcaaatctcttgagtttaaggtcagcctgttctataagagaaagttccaggactgcaagagctacacagaaaaaccttgtctggggtgggggaggaaagacaaaacaaaaaaaaaagtattttaggggctggaaacctgggttcaatttccaaaacgcacagggcagctcacaattccaattccagagcctctgacaccctcttctgacctccacaagcaccaggcatgcacatgatccacaaacataatgtgtaggcagaacaaccataaagcaaaaattaataaatctttttttaaaggtgcttcggtgcgaagcaggcggctcagccagtaaaatgcttgcctgaactcaatacttcaatctacataaaagccaggggcagtcatgtacacttataaacccccgccccctgtgttggggggaggggggtgatacacgaatttgggagtactgggcaggctggggaagaagacacccggggctcaccagccagccagcctagcctaattagctagtctcaggcctatgtaagactcaaaattaaagggtgtgtgtgtgtgtgtgtgtgtgtgtgtgtgtgtgtgtgtgttgataaagtacatgtctggctaccacgcctcatgacttgaactcaacctccagaagccacagggtagaaggagagaatggacagactcccagcctcccagaaagaacaactcctaaaagttgtcctgtgacccctccacatacacgccgtgtcacgggcaaaccaacacactaaataaaacactcgttcaatcttagcactcaggaggcaaaggcaggctgatctcctgtgagctcaaggccagtttggtcaacatttcgagttccaggccaggcacagctacacagaaagaccctagatagatagatagatagatagatagatagatagatagatagatagatagataaaacaggttgttccgcacccaataagaggttgtaggctacaatttaaaatagtgtttttaaactgaattaagagggctgcgaaattcaagaaaataagacattcaataaccatataataaaatcttctaatcaagttagaaataaatgtccaggattaataagaaaagaactgatgttcaaggaggggtgcacttgcacttgaacacagacaaagacatagtaaatgtgaaaaaattatcaattttcataaatcacaaagtgtgagacaatcccatcactcattgtcttaaatagatctggtcagcatagatactgtgtgaagccaaagcctagcaagcagataaggctgcacacacactcagcaggcacacacactgaatcacacaggcttatcagacaaaccaagggaagaggaggacctcaggcccatcgcagacttgactcaaagtactgagtagcaggaccctaccaaattgccatctctgatttcaactccatttcctaaaactggaaatctagaatttttacaacataaaagtgatttaaaaccctgtttccaatagcaaaacttaactcagtgtttagcagacttaggcctttgctccaacaatactgccacctgttaatgttgttttaaaaatcagatctttgtaaccagaattctggtgtatgattttaatcctagcacccagagggtagacaggcagatctctgtgagctgtagactagaccagggatgggaattacaaatggtttgtgagccgccatgtgtatactgggactttaacccaggtccttgagaggagttgccagtgctactgagcactgtctctccagacccctcatagttggcaggcacttagaattccaggacttagaaggcaaaggcaggagatctctaagtttgaggacagaaagttccaggaaagccagggctagagagagagagagagagagagagagagagagagagagggagagagagagagagagagagaacttgcagcccctcccccaaaaaggtcagagtaatgatactggcaatataacctgattaaactgaaagtatctttcactatacagcattcttagtaaaatggtttccttatgaactgccaaaagagactcgggatccttatatttcctcataaaacaacttatcaaaaacccagacgaaaacacatgactacaactaattaatttttacttccttctcgggacctaagaagccaggtctgcagtcatgtctacaatcgcagagacagcgcaacagcatctgggtgggcgtctcctgcagtcagagcatgctcctgctccttcagcaagccagtgtgatcagcactcaatgtgtgaccagtgtggtactaggagtcattatgtcctgacacgtgaagcctatgccaaccgtagagagcgtaacaagcctgcaacacatgttttattctaaaccccttttaattatcatcacaatcaaatttttaaaagctaagagcgaaattaaaaatcatttcaattctactcgtgccacccttcagaacctatccacagctgatctacggggctccattccctaattcccctttctacatgctgatcacatttcaggatatggaaattaaagaagggctggcttgtaggtgaccttgcaagaccactgtgtgtagatgtttttactcccaacggtcttaaaactggccaaacagacgatcccacaaaaatgaatccaatacccgacagcgtccatcttcagaggctgtggacttgcaatgtttggtacacaagcctactaagggtttagcttctcattattaatggtaagtgatacatttaagcttagaaacatatgtccaacatgtgtgtacatgaaaagctttaaaagttgtttgaaaatgtgaaaatgactaaggctcctgttacccttgatcactgtcagctgtcacacactcctgtctgatacatattaatccacaaagcaaagatctaaagggggcaattctgaatccaccagctgcatgcactgatcacacacagcaaatctacccaaggtcagaagtgtagcttttcaatattaacttccaaatagcactgtaccttagcttttccttttgagacaaggtctgtgtgccattgactggcctggagcttgctatgtagaccagctaacctcacagaaatctatttgtctttacctcctgaatgctgggattaacagagttttcaaactcacccagcctaacattcttttggaactagatttagaaacaaagaattataaggaagtaattaaaagtttggccccaaagggtacaaccatttataatggctgtacattatttcatcctttaaactcttagcctgatagttacactaattacatttaattttcaaaactaggtaatagagaggtagattatcttgtactcaaaggcttgttttgtatgattattcatttgggatgttggggtgtgagtgtgaatgtgtgtgttgaacttagagccctatcctaccatctgatctgcaacctcttgtccttgatccattgtgtgtgtccactctgaataaaactcagtcatgagcaaaaactaaaactgtaaccagttctacagaaaaatggtgactgtattaaacaaagatgacttcgaggccagagagattgaaagcagcacgtagttgaaagcacgtgttgctcttgccaaggacctgggtttgtttcccagctacttgtaatccgttccaggggacccaacagacacacatgcaggcaaaccattaataaccataaaataaatcagactttaagaagatgagatttacccaggcgtggtggtatacacctttaatcctagcactcgggatttctgagtttgaggccagcctggtctacaaagtgagttccaggacagccagggctatacagagaaaccctgtctcaaaaaaccagaaaaaaaaaaaaaaagttaaaaaccttttgagtaagaataatctggactcatagagaaagaccacgtgtcatagagatagaccacatgtcaaaaaaaacaaaaacaacaacacatttattacaaattgcaaaaatatcatacttaaaggaaactaccttaacctctggtctgacttgaggaatgaaacatgactacaaaatttcttctgaaagcattctgtacagcacgtggcctaagctcagccagccagcgaagtgcacacttggaatcccagcccttgggaagctcaggcagaaggactgcaccaagcgcaagagtccactaagagctacagagcaagtgccagacaaggtatcacagccaaaactgcacctcaaaaaaactgaagtaagctgctatttattattatattatttagtttattttgggggtaaggcaagggtctggtgcacatgccaatagcacatgccgtggtacaatatactacacacggttaaggcagagtctcctgttctgcttctacatctgcctgcccctgggccttaaggaggactctctctgtctccactcccatgtcaccttaggagtgctggataacagtgcacctagctttttatgagtagtatggcaatggaactggggtggtaaggcctttacccactgagcaatctttgtgggcccaaaaactacttttattgtaaacactatactcaaaatacaatactcctgctttagtaagttcactccacgttccaaatctatacctcactgtcagccgtctgtttctcatgaaacataacctcttagaccggaaggtgctggagctgatggctcctacctgcaacactaacacacaggagaattgccaagagctccatgccagcctgggctacagagtgagttataggccatcctatactacaatgtgagaccgtgtctcgaaataatgataatagcaaaataaattaaaagcaaggaagttggaaggggacatattggggacgctaaggggagttaggagagttattgagaatgtatacgatcaaaaaacactgcatacatgtatgacattctaaaaataaatttaaaatattgtttttaagaaggctttttaaaaagcattcacatcattccaagtaaaaaaatagctgtgtctttcccatttgtaatgaaaccacttaactggccctaaattacagtgcaagttttttgttgttgttgtttgttttttgggttttttgtttgtttgtttgttttttgagtcagggtttctctgtatagccctggctgtcctggaactcactttgtagaccaggctggcctcgaactcagaaatccacctgcctctacctccggagtgctgggatcaaaggcgtgcgccaccaccgcccggctacagtgcaagttttaaactatagtcataagtctgagtgtaacaactggttttaaaggttttgaaaaactagagtgagctaagtggatggcacacacctgtaatcccagcacgtgaggtgggacaagcagaaattcaagatcagcccagctatgtaactaggttgaaggtcaatttatgagaccttgtgtcgggggacaaaacaaaacaaaacaaaaaaaacctggtgaggctgaaagctcagcagtaggatgcttgcccagcaaaggcttgatcctcagaactgcagggctgagcacaagatgtgctgctatatcacagcaacaggactttagaccaaacccaggtctgcatagaagtcctcatgaagccaatccggaaaaaaaagtaaccatgcaggatgtaaaccatcattaaatataacaggcaagtgtgtcagacctattttcaccatcatcatcattattttaaagcttgccgagagcacatatgctctagaggacttggggagagggtgttcagtcccaggaggcacccatgacagacagctcctaactgtaaataactctagttctaggagatccaacctctaaaggcagtgcatgcaaatggtgcacagacatgcatgcaggcaaaacacccagaacacattaaataaatgtctaaagttaaacaaatgtccaagaatacatacaatatgtagtaatttgaaaaaaaaccaaaaaacaaaaacaggaaagtgaaaggacagaggtgttgtattcagggacaggcacacgggaacaaataaagttcaagtacagggttcaaaagaatacctcaaacatacatcacagcacacaacatacaatgcattgcttaatttggtgcttttaattttaaagtgcaaggtatgagtagctcatctgccatctgggtagcggtgcagaaatctgcctgcctctgcctccggagtgaggtgcagatacatacatgccatttattactccacttaaccctcagacagtgggctagaaggaagagctcaactggaacagagagaaaacacaattcactccaacccatcaaaacaccaagggaaaacatggagcagactggactggatgcctaagctatgatatccagtacttgattgttcctcacagacttgccctcccgtcctcccgatcagcaagccacctaagaactgccattagaccggctggattttatctctcctagttttcttcttagaagaaagaatactgaggagaggaggaaaccacaaatatgaccaaactacactgcattaaatttttgttgttcacttggagagactgatatccccaggaataaccctaaccacacctactgagacttcatcccaccttccttgcagtggtggccaatgcctttgaactcagcagaggcatgcaaattgtgagttcgagagcaaggctgggctacaagtgtgagttccaggacagccagaacttcccagagagaacccaatttacaaacaaacaaacaatttcactatgatctagtgggcaagggacagaaaacagaagtatgtgcttagcaggtcttcaatggcaaagactagatttgtttaagtttgagatgaggagtgttggtttggcttttgcatataaggtctgtgacccccacctgtcctgaaactcattaggaagaccttgctggccctgaagaccctggcctctaaaatgctggtgttacaatctgggctaaatcacaaaagaaggactatgtatgtatgtatcctcacttatccccacaaacatctcctttagaagtactattagcattcagcactgaggtgtgcacctgtaatgacagtgctccagggtggaaggagtccatcattgggatcaggccctattatcttctccagcctgggtcacctagtaagactctcctatctgttaatctcaagagcaatcttgtgtttttatgagtggggagaagcaattagaagaatacttacatgaagaaccaaatctatcaaccaaaaaaacacacagatagaaagaacctgagatctgcaaagtataccaactgatcattatgaaaacttacagaaagaccacatcccttattagcttctatacaacaaaagaggttgtcggtgctttctggctttatgctgagagttactatatctaagcaggcaactggccagattagttgatccttacaccccaaacaaaataagcttaaaaaccagttgaatagtttggctttaaggcagcaaactttataaacttcccatcagtggggcttatattttagtaaggtagcgtataatcaaagcaagttttcaaattaaaatgaaggacaggcataaatgcagacttacaacctagcagtcggtagctagtggtagttttgcacacattgattcactacaaccagaacgtctaaccatatttactttgcatggagaaagataacatgatgtattaagaggtccaaaaaggacatcttggaggcatctcctcccactacgtgggcctcgggaataaactcaggaagcaggtgtcatgactagctgagctaccttacaaacccatcaggagaacttttagaactacaatttttaagttaaatgttatatttaaaaagtgactattctacccacactgtatttccgtatacactatattgtgagggtttatcttgactgacagcttgattggactgagccaccaatgcctggggtggcacagcacacctcttgggtgcatctgcagactcttccagagctggcaatgagctgcaaataacagggtaaagacctatcctggctgtaggtggcgccatccaaaagcccagaggaccaggcagactggaaacactgagttctttaatgtaaataaacaatacaaaaagaaaccagaatagacaggttcctgagtctgatgaaacccttgaagtgttcccagcaggtggcaagaaaactgagcagtaccccagccgcagtctcttgttgtgtggcttgcttggggattttggggggggttcttggggttgggggggcaacaaacaggaaaacaaacacaacaaaatcatgtagcaaaattccaaatgggtagcaacagcagataacagaagaagtgaggggacaggctcttgacctacagaagactaaaattagaaagagaaagtggaacaaaagtaaaagacagggaaacagcaaagcaaataaaacatgcttggtaaatgtacccgaggtgggattcaaagacccagatgtcaggactagttaagcaagaacttgcaggaaaataaatacaaacttcactagctgggtaaagcacaactgctttctgggcagtcagacagcttttctaaccgcattttactcttctgatgtactattaaaggttaagaacagtggtagataaaatgttatttgtctgcacaagcaatcagagaaaaacagcaaacatggcgttggggctgattccaatttgtttttttgacagggttcaccttgtagccctggctggactgcctctttggggactaaagcatgcatgccaggcagattccaatattaaccaaaacctttcaaatattcacagaaaggtaggcagggctgccttccctcctgccccactttgattgtgtttgtctgtgtactacagacaggacccctatgtgttccctcagccaggctcacttgcccaaccaccaccctaagatgcacactgagcagagaaagcagagcctctgggcagactaagtgagaaggaaaatcacttcgaccagtgaggggagcacaggaattacctgacagcctggtcaggaagggcaggaagagcttcgttttaccgatctcggagtccactgttcagcaaatcttttgatcctaaggataaaagaagggaacagttattgtctctttaaattaagcatttgtatcagtcctacctagattatcccatctctcccttgatgtgtgagaaggccaccgtgcacagagtctcctctaggaatcaactagatgcttgctttgccatagcaatacttataatttttgttaaaaagttaagcacggggctggcgagatggctcagtggttaagagcgccgactgctcttctgaaggtcccgagttcaaatcccagcaaccacatggtggctcacaaccatccataacgaaatctgatgccctcttctggagtgtctgaagacagctacagtgtacttacatataataaataaatctttaaaaaaaaaaaaaaaaaaaaaaaagttaagcacaagccgggcatagtggtgcacgcctttaataccagcacttgggaggcagaggcaggcagacttctgagttcaaggccagcctggtctacaaagtgagttccaggacagccaggactacacagagaaatcctgtctcaaaaaaccacacacacacaaaaagaagaaggaggtgagcacagcattcacaattaagaagacagtggggtttatactgtgcacgatcactcagtgatggacaagagaaagatcaacctgacctcaaattactatggtcatttaattccttacaaatttaagtttagttctagacaaacccaacctgaaagatagagaaaacaacagccttagctttccaaaacaacctttgaaaagacagttttctgaaacgaccttgtacaagaaaatttcaattaaataacttgctgcaactttatatgcctcagtacaggggaacactagggccaagaagtgggggtgggtgggaaaaggaggggagggggggtatgggggacttttgggatggcattggaaatgtaaatgaagaaaatacctaataaaaggaagggagggaggaaggaaggaaagaaggaagaaacaaacaaacaaacaaacttgctgcatgtctgctgcatgctggtactgtgttggcacacggcaatagatagaattcatggaccagacatggcagtgcacacctttactccccacatcgtggcagaggaaggcggatctctttcagttcaaggccagcctggtctacagggtaaatttcaggccagatagggagaaagggagagggagggggcagaggggaggtgaaagatgggggagaaaaagggagaaggagagtgtcagggaaggggggaaagaaggggaaaggagggaaaagaaagagggagggaaaagacaggggggaggggaaggaaagagggaggggaaggaaagggggaagaggaaggaaaaggagaaaaatcacaggagggtggggcaggtggcttagtggttaagagcatatagaaagcatatatcaaatatctaatattcatatattatatcagcatattaagaaatctgagcttggggccaggcagtggtggcccacgcctttaatctcagcacttgggaggcagaggtaggtggatttctgatttcggggccagcctgatctacaaagtgagttccaggacagccagggctacacagagaaaccctgtctcaaaaaaacaggaaagaaagaaagaaagaaagaaagaaagaaatcaatcaatcaatcaatctgagcttgtttcccaatacccacatcaggccactcacagtcacctgtgactcctatcttacatctctggcctcaggtagcactgcagctcacattcagatacacacacacacacacataattcaaaataataaaaacaagtactataaaagtcatggtaccactattactcgtgggtaatcagaagcaggtacaagcaggcactacaactttctaaaacaacaatgccacagaagtgagcatctaatgagcgccgtgctgtggacaggaggagcaacaggggaaggggtaccaacaccacacaatgggcaaccctgaagactactaagatgtgacattaagggctcttggggtctcccagagactgagccaccaactagggagaatgcatgggctggacctaggaccccagcacatatatgtggcagatgtgtagcttggtcttcatacaggtcccccaacaactgcagtgggggctgtcgcccaacagtggatcccgttcctctaaccgggctgccttgtctggcctcaatgggagatgtgcctagtcctgcagtgacctgatgtgccaaggtgggttgataacaagggatgggggggggggggggggcttctcccttatcagagaaggggaagcaggggaatgggagaactatgtgaggaaggactgggaggaggtagggggctgcaatcgagatgtaagatagatagataggtagatagatacatagatagatacatagatagatacatagatagatagatagatagatagatagatagatagatagatagatagatagggagaaatgtgaaattaagacaaattcacagctgcttatctctgccaaaaataactagtggaatcagacaatttctgcacatattacctagatttacaatcaaaatgcccgttaacgcctcacactgaaaagcaagaggcaagcatctgcaatccaaaaactgccaaggccaaggcttagtccaaagccagcctgggctatataggtaagcctgggctatataggtaagcctgggctatataggtaagcctgggctatataggtaagtcctctcccaaaaataaattgtgacttgaagacatagagggcttgccaacatgtacaaaaaactgggttcgatcttaggaccaccccacccccgaaaaaggcaaatgggattaacagacagtttagagaatgtttttattcattcgtatgtgagtgtgcctgttcgtgtgcgccccatcacagaaatggtgaagtcagaaaagaacctccagatacttattctctcagccaccatggggccccagcccagccttggcagcaaactcctttacccactaatccaactccaataatacgtatataatgttgggcatctaaaagacaggatacataaacgaaatgaatgaaggtaactaaaagtgaaagtttttagctcagcacagccggatgtgatgccatgcattttctcaaacacacactacatgtagcctcagagggggaccaaaaaaagggggggggtaaataaaacttttaaaaaatgctgggtgtgttggcacatgcctttaattccaacatcaggccagccagtttacacagtgggacattacctcaggagaactgagttgcggggcacagcgttctgcatctgagcagctaaggaaagagcacagaagcctagtggcagtagtctatgaactggcctcacctctttgctgagcttaagttagtaaggacctagttacagaaaggaagctggcttgtcagcaagctgcttgcagctgcttgctctacagctcctccctccctccttctctccctctctccctctgtctcacccactctctccctctctgaaaagctaagtcctgcaggatcacacaaaataaatacaggcaaagggggtgggagtgggggtggaggtgagcaggctccaccagtagaaggctttccacaggaactgctacagggtcaaaagtttacagtggtttcaatttcaccttttagcagccaatcagcaaatgagactgtgctgaccctcgggctgcaggagcgttaactccctggctaccagaactgctgctgccgttcctcctggcttctcttaagaagaaaaggggtgtttgtttgtttgtttgtttgtttttaaagggggcagcggacaccctaagttcaggtgactgatttgtgcagaaaaatgatttgataattatcccctttctccttcaattcaaggtttctttatcttagagcatccaacaaaccaactgataatgatataaagacaaagaaataattggggtatgttaggaaaatattttcttccatgacgcttgaattctaccaacaacctaaagaactgataggagatgatacccgtttagttccctgtgaatgctttgaaaagagactcgataatgaaggctgtcaattaaagtgtttaggctctgactccctcaggtcactgatacaactcttttcacaagaggcggctacagaaatacagctagagcttctcaggggccatgtgtgtcctcatgttctcgccaaccccccaggacccagtgcagcctccgcctggaacaaactggaaagcaaagcctttcagcagagctggcctcctgattgctctttcatataaacgtcctacaaatgcaaaaactcaatacgctgatccatcaccactgctctcagagttctgtgctgacagtgggcagggccaagatggagaggacagggcaggcacaacaacatcccaccccggcccccatttccccttctctctcctcctccccagggcaataaggaagcaggacattgacgcccgagagcttgaagccagcatggtaatttggggttgtttcggttttggtctttggggttttggtttttttttttcttttttttttttttttttgcgtgtttttttttaaagggatggttatgggagggaatttaagacaatctctctctaaagtcccaaatggtggaaaaagcagcaatcctcctgccccagcctcaaagtcctaggcttacaagtgtgagacaccattccttgaagcccacaagacaaggaggaaacagctgtacaaactctcctatggaaatgacctagtaaatcctaatttatagattaggtaacatataccaactggttgaatattagcagttttacaagtttagatttgagacccatataggcaccgccatcggctactaaaacgatcccgtataggatagtaggttctgtccaaagtgagatcatcaaataccagctatttctgaaatgcaattggtaaccaataaattataatgcatcacttactatacagcaaccagaggcccagagtacagcatagtgtcttcattacacagaaactctatagtgcatcttgatatacatgtttcagaccatgaataaaatcaatattataatttcaagttgaaaaaaagatagaattaattttctaataataacttccaaacccccatgatataattttatggctataattctaattttaaaatacatctagtttgttctttttgccatggcttacagaagcgtgtgcatgcacgtttaatttgaagaatcttctctttttacaggatggcctcattgcacaggaaaatggatgcgacaaaattctatatcaagtcagcatgttagcaagaatcttttctatgtgttctgaatttgattaattcgagccaaggtcacttcctgaacaatgcctgccactgcagctgcaggcaaaggctggcatgaggctgggaggagaaagagggtggggatgtttatttactaagaagcaaatgggttccatttccacacagttatcttggcaagaaaaagactggcaagctcctgggatcctggtacataaagatgaaaaatatctctattttttacatagaaatgtaattcaatgagcataatgttcatgtcaacgttatatctaaaaggtcctcccagataatgtgcaaaaaccattaaccacttaaaatgatacaaataatgccagacagcaaggtaaaccgaactggcaagtacacagtgaccctaacttgtacaaaaggaagataaggtcttacagaccacagactcatggttcccttgaccaacaccaggaaaggcctaactcaagagtaaaaaatccaaaacttattattttctaaataaaataattcataaaaatttatcctgacatgcaattgaatttttacctcagcattatgcaaatgttatgtcttttttaaaaaatctcaaagtagggggctggtgagatggctcagtgggtaagagcacccgactgctcttctgaaggtccagagttcaaatcccagcaaccacatggtggctcacaaccatccgtaacgaaatctgactccctcttctggagtgtctgaagacagtgacagtgtgcttacatataataaataaataaataaataaataaataaataaataaataaataaataaaatctttaaaaaaaaaaaaatctcaaagtatacacatcaatggcaagtaaagctatcagtgtctgctagcacagcaaggaaacctaaaatataccacacaccccgtctgtacggctttgcaccctacaccagtgagctggtaacaaacataccggcagagtcaggaaacctgcatcttctgtaattttctataatggccatctataaaagcactgtgtgatatttttcaaatatcaatcaaactatgatgttccagatacgtatcatcatcagagaacccatgtgcctttcttggttacttgtttaatgtactgtgttattttttaaatttttatacaatattttttgatattttccccctttcccaactccttacagattctacatatagatatgagatttcacctcactgtcttctggctaccttaaaatggaaatccccctgcctcaggttcctaggttctagagtctggtatgcaccactaggcccagcttaaatgtgtctttcatgctgtgggtgaagcccgggccttgaccactgctctacctctgagcagcattctcggctcacctgtttttgttctcttgtacctcttgttttatgtagaacaagctctcactataaagtccaggctgtcctgaactcacccacttagccatgactggcctggatctcatgatactcctgccttggcctccgaagtacataccaccacacccaagttgtgtttataatggttgggtaacacaaaactcactattacaaaaaactgagggaggaagtctgggaagatggcttgaaggtcagagcacttactactcttccagaggtcctgagtttagagcacaaacatggtagcccacaaccttgttaactccagttccagggaattggacaccctcttctgacctctgaaggtactgggcatacacatggtaaaaagacaaacatgcaggtagaaaacccaaacacaacttaaaattttaatacataaaaatttgaattaaagtaatgacaaaagcagttcacactgtcttcaaataagcccagcactttcaaaacaggagggagcttcagccaaggtcaaaggcagcctggctacctaacaagagccacctaagacaaaacaaaacatcttgtcaatgtatagaagggtattattcccattctctacatacgctgagaatacagctctatctttctggcttctcccatgctttttctgacaacttagatgtgtaatcaacaaaaggactttctatatcatgttaggaaaaggaagttaactgtgttcacacagggatgaggccttggactcagagagctattcatggttgtggtaagaaagtggcttgctccgggcgtggtggcgcacgcctttaatcccagcactccggaggcagaggcagaggcagaggcagaggcaggtggatttctgagttcaaggccagcctggtctacaaagtgagttccaggacagtgagggctatacagacaaaccctgtctcgaaaaacaacaacaaaaaaaaaaacctcactatgtagaccaggctgacccagtggtaggattaaagatatgtgccagcacacttggcattgtctttattcagcctgagtttaatatttctagcccttcctatttcaggtagcagttataacgagtgggtggcaggtctcaccattcctttaggtccaggacactctgtttcagggtacatgtgagggggaaagatgcagtccatgaattcagaatatatatgcagtaaggggctgaagcaatgactcattaaagtaacctggagttcaaagccccagcacccatgtaaaaaggcaagcacacgcctataatcccagagcactggaaagatggagaaggttcctgggttggctacacagctagtctagctgaatctacaaactctagttcaatgagagtacctgctacaaaaaaaaaataaataaataaagataaaaagcaattaaaggcacccaatgtcaacctctagcatatataccctcaaacggagctgaggcaggaaaattactgttggttccagacaaatgatggcactcatttccaggccagcctgaccgcagtgtaaaatgccttcaaaaaccaaaaaatgagccaggcactgtagcacatgcctttagtcccagcactcaggaagcaaaggcaggcagatctctaagttagagaacaacctagtctaaagattgagttccaggacagccagaactacacagagttaggaaagagggaggacgagggaggagggaggagggaagagggaagagggaagagggaagagggaagagggaagagggaagagggaagagggaagagggaagagggaagagggaagagggaagagggaagagggaagagggaagagggaagagggaagagggaagagggaagagggaagagggaagggaagggaaagaaaaactgcagatggcatttgtcttactgcttttcctattgctgtgataaatatctgacaagatcaatttaaggaagggcggggcgttccaacttccagctcaagtggaagcacagagacagaagacgggtgtttgccctcagttctttctcctttctacatagtctaggattccgggtgcatgcatgattaccgtgggtaggtcattccatatcaacctaatcaaggaaatatccacaggcatgcctagattccctgtctcctgaatgacaaccaagagtaaccatcaaaaggctacagcagagtagcaccctagaaatgtcaggcacagcagcacacttgataacccacagctctggggaggctgagacaggggagccctgggaaatgctggccagctgatctagccaaatgcgtaacccagtctcagaaaataaggtaaaaaaggcattctagaagatatgcaagtcttcatacacatacacaaccacctaacatgtgtgtgtgtcaaacacacaagtacacacacacacacacacacacacacacatatatatatatactcccaaaaagtatctgaaaaatgattacaagaaaaaaaatcaacaaaaagaaaatgaaaacctaaattttcaaatatgaaaaaaaaaagaggctgggaaagagcataatcagtaaagtgcttgccttgcaagtacaaggatccattttgatacttggtgcccaggttaaataaccaacaacacaacaaccaaaaacagcactgtgagcttagtggcactcttgtaatcccaacactagaaggcagagacaagatgatctctgaaggctcactggtcagccagtctagctgaactgttacaagtcccaggacaacaagagacctgtgtcaaaggaaacaaagaatttctatgcatgacacagaaattatgtttctgtgagtgagcacttgagcatgaagacacacaagtatggagggcaggcaacatgaaccagcagataaaggtgcttgctgtcaaggcagatcccctagagccacacaggaggacctaagctgtcttcagactgccatacacaaacatgtaagaaaaaatactaaatgcaaatgccttagtaactgcaaattcctataataaaatactaatgtacacggaatagatctactgaagatacaagacaataccaaatgcggaggaaaatgcaaaccagtggggctttactggactgatagggacataaactgggaagaaaaagagtgtatttaaaacttaaaactttccatcatatggcaataacaatgtttacaaaactataaaaccatagttgtaactcattaacttattaggaaagactctcatgtcagctctagtagctgatgaagcattctgacgaagccattctcagatatgctaaaatcccatctgtcttccgtggcatagctcaacaagggtattctaagcagattttaaatcagtctggctatgcagctaattagagccaatatcgactcatatttttttaaaaagtcaattctctaagtcctgtcataacattttaaacaagtaagaacagtcgatagaagttactaagttgggggcaggagagggggctcattcagcactggctgctcttccagaggacccaggcttgatttccagcacccacatggcagctcacaactgtctgtacagttccaggggatcttatgccctctcctgatctcagtgtgttctaccacatatgctgcagacatacatacaggtaaaatatctatacacataaaataaaatgcaaagaaaggaagctagctactgtaagaaactctgatcaccatctgctttcctcacaggtagccttgtcccggagcagcagcagtccggagctcaggatgtaggagctggccttatgctcctgcctcagcttctggagtgctgtgattaaagccagtgcttccctgagccactgttcacttagtccccttgtattcatcacttccttcctggtggctgtctctgaacccttcccactggctcagctacagggttcacacagtacgcacagaggacagaatccagagcttgagttaccttcccaacactgccccccaacaaaaattgagttacaggtatgtgggatggctcagtaagtaaaggcacttgtcaccaaccctggcaactgagttaaatctaggtccctccattatggaaacagaaccaactgtaaaagttatcctctgacctccacatataccctatggacatatacataataaaggatgaataaaaaatttaattttgccgggcggtggtggtgcacgcctttgatcccagcactcaggaggcagaggcaggtggatttctgagttcaaggccagcctggtccacaaagtgagttccaggactgccagggctatacagagaaaccctgtctcgaaaaaaaaattaattttatattttttcttaaaagttaggaagaaaggaagttagttcactggttagttaggaggaaggagtgagttagttaagggctggagggatggctcagcagtttagagcactggcactctttggaggactaagattcctagcagcacaggtgcctcaaccatctgtaactctagtgccagagacctaacatcctctactggattctgagggcactcaatgcacatgatgcacatatagacatgcaaaacacaaatagaaacctttgggaaagatgctgagaataatcacacaatgatctaatgcagttttttaaaatgcaatgcatggatataggtaagaaagccaggcatgggaacatggctgtaataactgttctctgtgaagttaagccatgactgtcctgagtttggggctggcctgagctacataatgagttcaaggccaccctgattgatagacacacatacacaaatgcgctgtggaatgtataactgtattttttaaatttttttattgttttatggcagggtttcatctatactagacttgcctcaaagtaagcttactattacacaaagattgcctgcctccactttctgagtgtgcaccactaaaattgactttagcaaagataatccaattttactatacaaaccagtgactctgcaaagtcacagtgggcatggggaccagcattcttcatagggaaatgaagtgcagttacttgagcaggttcccaaaccaagaaggatcagggtatgtccaatagcctctcttgtagatcatatcacgccataccacaattgttttggtttggtttaatttcattcattcattcactcattcattcatttattcatgtatttagaaggcatgcatatggaggccaggacaaacccataagagtcatgtaggtcatggggatcaaactcaggtagtcatgcttggcagcaagctccttgacccactgagccctctcactgccctaacagctgacatggatttaaatcatctctgcttttccattagcaaaataatcgtctaagagcacactgcttcagaaataggagaaaggagacaattactagctggtgagtattacatggaatatttacagatctcacgagagagagctcagtgtaaaatatctgactagatactgtacaggagtcagctccctgtgagaaggaatctgtctaatgccgaaagcacagctaccagttagagtgtaattagcttaaaaaaaaaccgaagtcagtcaggtgtgtgagcggcatttactatttgttccctttgtacaggaagcactcagctctgatctcaaagtcaccttcaagcactaacggaagcacaaggctgattcctccttgcccagaacaaaacccacagcaaagaccaacgtaaggggacatttctctccacgttttccttccccaagaaacagctttataaaccatatgacgttcataatgaaaagattacaatttagaaaccgaggagaagaaaaattaacaggagcatgagacaaaaagagcacatgccctgatacagaagcctctgaaattgcttttggaaaaacatgggacaatcatctaattatcagatgaaacaaactacaacttagagctcaatttaccagaggaataaatactaaggcactctgtattacacttgtaaatgaataaataccaagggaggtatggcagacgttctaaatgcaatcaagttaagttgttgtttttaaatcgggcattataatctatagctttatagatttgccactaacctcctaatctggcaggttaaatttcaacattcaaagtactggttaggttttctagaaatggtccagtaagttgacataataattaacgctgtttgatctacaaaatctgagtactcagtgctgagagtgatgagtgaccttgaggcagctcttggaaggcagtcaccatggcaacgcttccacaaaagtgcctcatcctcagcaaaaggcccaacccagagcataaggatctttaaagcagaaaacctccgccctcacccacagcctagcaaggggtcacagtttcttttaaaaagtctctacatcaaccttcctgattattctttcagagaaaatacaaattagcttcacagccatttatctggtctggcaacaaaacaaaacaaacaaaacaaaaactatcttttatttgctaaatgggaagaattcattttgttttggaaaaatatgtttcaatacaattagtaccattttactgtttttcgttcaggaatggtaacacagtggtaatctcagggctgagaagtctgaggcaggacaacaggcagtaggatgctagccctgggatatatgctgcattaaaggagagaaagaagggccacacaggggcaggacactggagtgggaagacattatcttccagcatgcacttaaagaaggaagcacaaaggaagcagatttcagcccagacacagagtgcactcatgactgtctacatacaccacggcttgctacacttagtgttctgatgacgctgtgttcccagctccctccagcagtgcttcctgaaagccgggaggagtcattttattatcacaacagtcagcagaacctcagcaccagatactgaacaatttcacaattttctcacagagctaccaaagcattcctgaaaagctgtgtccagaacagctaatgtttttcagcctaaatacaaagatcttatcgacttttccatttttactgtatataatctatttgttcattctttcctaccccaccccatttaccattagtttgcaaagccatgagtactgactgatgagatgactgtgtggggaaaggaatttcccccccaaaactgctagggcagacatgaaagaaggtgcacacaacgtgcaagctggtatacatggagggctgcaggccaactggagcctcataatgagaaactatgcagggttttgttgtcattttttgagacaggacctttctatgtagccctggctgcctggaactgcctatgtagaccatagtggcctcaagttcacagtcatctgcatagcctctgcctcaaagtgctaggactaaaagtatgtgctaccacacctagcaaaaagaatttttacactaagaaaaaaaaagatagcaatgtgagcagggcagtaggcaaatggatttctgagttccaggccagcctggtctacagagtgagttccaggacagccagggctgcagagaaaccctgtctcgaaaaaccaaaaaaaaaaaaaaaaaaagatagcaatgctatattaccaaaataagttacaaaattaagttctacccataacatgatatactgtatagtgtcaaaaaggttcacagcacattataaaacaatataatctcaattctctctataggttctacttatacatggcacttacttggacagtctgaagccaagcactgaggctgcagtcccacactggaaggttcagttaagagaactgagactctgacacaagcctaggctctatagtgagaacttgcatgtgaaagactaaaatcacagtcattttttcctttacatctttgaaggttttgtacatgtcacgcaatttcaaaaaattaactccttttttttttttttttgagctagttatggagatcagcaggacctgaaattcaaagagagctgactgtttctgcctcatgagtactccaccatcctggctagaggtattttgtttgtttttaaagtcaattcccaacgggcctataatctcacacgcttttttaatcccagcacttgggagccagaggcaggcggatttctaaattcgaggacagcctgatctacaaagtgagttccaggacagtcagggttatacaaagaaaccctgtctcaaaaaacaaacaaacaaaaaatttctgtggggcgagaaggatcgcttagagcagcagttctcaacctgtgagtctccacccctttggagtcacatcagatatttaccttacaatcacagcagtagcaaaattagttacgtatatgttagtcagggttctctagagtcacagaacgtatgggtagtctctatatagtaatggaatttgttgatgacttatagtccaactccccaacaatggtcagcagccactgagaatggaagtctaaggatctagcaattactcagtcccacaaggcaagattccttcttccaaagtccttatgaaggtctccagcagaaggtaaagcccagattaaaggtgtgtgctaccactcctttaatcccagatgaccttgaacttggagatcttcctgtcttaatcttctggaattcatggccactatgcctcagtaactccatgccaagatccaggtcagacacttgtatctcccagcctctagatttggatcacaggtgagcctccaattctagattgtagcaatgaaataatttgatggctggggatcatcaaacaagaggaactgtattagggttacagcattaggaagattgagaaccactggcttcgaggatgaaagcactggctgctgctcttccagaggacccaggtttaagccccagcatctatatactggcttacaactatctataatttcaacactttctctggcctgcctgggtaccaggtatatatgtggtgcacagacaaacataaaggcaaaacatacaaacatatataacaaattttcaaaaagtgaaaaatttcccaccccttgagactccacactgtgcttcaaataacatactgcacagaggcaagagctcgggcttaagtcacacaggctcattggcagcttctctattagtcatggctttgtacaataactcaacttcttctttctcaccaagcctctgttcttcctatccaagaaagagcatacacggaactccaatctccatcaacactaaaccaagggggataacaggcatctcaatctccttcgtgataggccatctttaacaaatacttcaagcaacaaatcaaataagctcttggctttttgtttgttttgtttttctagacagggtttctctgtatagccctggctgtcctggaactcactctgtagaccaggctggtctcaaactcagaaatccgcctgcctctgcctcctaaatgctgggattaaatgccaccactgcccggaataaagtgacagttctatacagccgtgagccatcaagtacttgctgggatcctttggatccacggtcggtgcccttaccagctgagccacccctccagcacttttttaatgaagggttccactatgtagctctggctcccctgaactcagatccaccggcctctgcctcccaggcactgaggttaaagctgtgaccaccaaacccatctgtaaacccttctgaatcattcattgtaattgaatgcctagcacccacacatgtcccaggagctctgacatcttccaccttcttgaacaccagccacacatgtggtacaccagcatatatgtaaggttaaaacactcatatacataaaaataaataatggacacaagaaatatttttaaagtaaaggtttcttagacaataatagatgccagacaggaaaggcaagaccgggtctcggcgcaagctcccacaccagcagcagtgcggctaggaggcacctggtaactggatctcgctctctcactctctccgcctacccctgcccctccccctcccccaccccacccccgcaaaattaattttagagaagaaaagcaatataaacatattatctatatagataagggggcaatccttaacaactacctcttctgcaccagcagccgctgagaccaggaatggcttttatataaaaggggggccggccctatggtagcatccaaatcaaggttccagaccagagctattatctccctaggttcattcccttatcttgccctttcacacttggccttttcagtaattaaatgcctggtgccctctcagaagaagagatgtctcggggcatctgagaggtttttctcttttggggacacactatcaggtgacccagactgaccttgagattcctatgaagaggaccctccctcctgtgacttcgggtacacataggaagcctactggcccagctcatggctgtatttctagaaacagttccagacctaagagatcatggttaaaatgaaaccagagacttccttaacattccctctcagagtatcttttatgattcaggggctggagaaatggttccaaggttactgtagaggatccaggttcaattcccagcaccacatgatggctcacaaccagcctttccaggggatatgacaccctcttctgacctctgagagcaccaggcatacacataagcgggcaaaaccattcctgccttctctgaggaatgctttatgcatgtatctgattaaaacttttcacttttaaatagttatttattgtacatgtgtctatgaatgtatgtaaatcatgaatatgcacaccttggttgacaagcacaaagataaatctctacagtttgtgtttcttcatctgaacaggggccacaggggaaaggagtggctcagataaagaaaatgaggctggcaagatgactcagagggtagatacttgctactaagcctgacttgagttccatccctgaagcccacatagtaagagaatcaactcttgcaggttctctctctctctttctcacacacacacacacacacacacacacaagcaaaacatgttacagaaatatatttaaatcctaacctagacaaaccaacttcaacctccttcctcatctagaagcaattattagcacaatttatttgaaaattaatcttgcatttgccttgctaaatttatctcattactccttgaaataattcttttctagttatctagctttcctgtttgtttctaatgtccccaaatagaccctaacctctcaaggaagggttatggtcatatactgttttatacaaagatgcaaagaactagatcatattagcccccttttaaaaagatttgtataaacatctgctgtgcacctgactgggtatatgtatgtacaccacatgtatttaggagccaatgaaggtcagaagaggcatcaaattccccagaagtaccatgagggcactgggaacagaaactgcaaaggcacatgtgtttttaactgctgagccatgtctctggccctatataagtcttcttaatttgtactgatgaagtaagtcagtgtcttgtgtgtgctcctgttcctatgccacctccagagctcagattactggtatttaaaccactgtgccaactatatgcttatttcctggaaaggaaactttagttatattagaaaatgcagcaaaaagtaatgaaaacaaaaacaaaaaccctaatgaaagaacagggacaaagagagaagggagcctggcacatacatttgatctcagtacttgggagttagaggcagggccagcctggtctacacagtgagttcttcgacagccaaggctgttacagagaaaacctgtctcccaaaaaaaaaaaaaaaaaggaaggaaggaaggaaggaaggaaggaaggaaaaaaacagaaacagaaacagaaacagaaacagaaacagaaaccaaacaaaacaggctacaaagatggttcagtggttaagactgctcttccagggggctgaagagatggctcagtagttaagagcacagactgctcttccagaggtcctgagttcaattcccagcaaccacatggtggcttgcaaccatccgtaatgagatctgacgccctcttctggtgtgtctgaagacagctacagtatattcacatatataaaatgaataaacaaaatctttaaaaaaaaaaaaaaaaaaaaaagactgctcttccagaggtcctgagttcaattcccagcaacagttggtggctcacagccacaatctgagggaatctgatgccctcttctggtgtgtctgaagatagctaccgtgtactcccataaaatacatctttaaaagaaagaaacaaagaaacaaagaagaaaatagagaagaaaagaaaaaaaaacaatggaaggggtgaggggaagaaaaggaagaaatccttagggctatgccacctactgatgtcaagcaagaagccaatgcaccatgtttctgtagtacctacagcaatgctgagtcatgacaaggaggactgcccactgtgctcctgaggttactactcatctgaagatgatggccacagggtcaggattttatatgcaggagagtctagaggaccagctcagcgtttaagagcattggctactcttgcagctttggctctcaacccatccataactgcagccaacaccttcttggaccttcgaagtaccaaagaaacgcatgctggcatttttataagattttatatgcagtgcttgggtactttcctattttgaaatcataatgtagtttattagtgactgtctttagaagtttaattggctagttattttcatttgctttctttcctaagtagaatagagaccttcaggttcagcgagatatatctcaagggaatatgaaagaataaggaacaatacaggaagacttcttgatccagtttcctcataggcatgcatgggcatgagtgcacacacttgtactcatacacacatacaataataagtagtagtagtagtagtagtagtggtggtggtggtggtggtggtggtggtggtggtagtagtagtagtagtagtagtagtagtaaagaaacagagtgaactacagggatgggccagtagtagtagtagtagtagtagtagtagtagtagtaaagaaacagagtgaactacaaggatgggccaaaggttaattaaaaccacaggctgcgcctttaatcccagcacttgggcagcagaggcaggtggatctctgaggccaagactcataccaaaaataagtaagtcttaaaatatattttaaactcacaattgaatcaaaccacagtctcaggagttgaaaaggggggctttgataaatcaaactgaaccagagctgaggatgtaatcaatggcaaatcctttcctgctgctgaaagcctagcttgcatgatggtggctccacctgcaatcccatctctcagcagatagaggcaaagaaatgggaggtttaaggttgggccttaagtcacttgtcccaaatttaaccacctgagttcagtcctcacaacccacctggtggaggaagagaacaagaaacctttaaaaaaaaattcaagataaccctcagttacacagaaaggtccaggacacaaaagacctccccaccccaacccccaccagtgtatggaagaaacccaaaaatccagttagaagcacagcaactgagggaggcaaaccgtgagagaaatcttgccaacagaaagggttagagaaagtgaacagccagagcgcgtgctcagggctcaatgtcggctccaggttctacaaaccaacctcaggagactcactttaaagaggaaaaacaatgttcttattaatgaaagaacaacctctcaggagacaacagaaattgtgcatcttaaagttacctggaaatctatctagcaatcgttcccccaaagccttagcactgcagtgacggagacagaagaccaagatcaagaagagttcaaggttggccgggcgtggtggcgcacgcctttaatcccagcacttgggaagcagaggcaggcggatttctgagttcgagtacagcctggtctacaaagtgagttccaggacagccagggctacacagagaaaccctgtctcgaaaaaccaaaaaaaaaaaaaaaaaaaagagttcaaggctggcctgactcaatccactgacagcatttaacagacacagaattcttttaatctccataatatcaaatacctaagaataatttgttttggttaagccatactaccattacatatgcatgaaagacaggtatttgagtatgtactgcactgtctataatgaataacaagttcttctctggacagactcaaccaaactccatcaaatgtaaagcaaagatgctttacatctgccacattaaacggaaatccaacattcattatttaaaaataagcctttgtgctatgcagacatccaggagctgatagcattttgttgagataaaaagcagttggcctggagggatggccagtgaggaaagtgttcgtccacaagcctggcaccctagaactttacaccaaacagactatcacaagttatctcctaacctacccacacacgcacacaccacaacgtgcacaccagctcacactatggcaggcaaacacacacacaagttaaaacttttttaaatttatgtgtatgtgagttcctgcattggtttattatgcactgtgtacatgcagggcccacagaggacagaagaaggtgcctgatcccttagacctgagttacaggcagtcgtgagctatctgatgtgtgtgatggaaaccaaacctgggtcctctgccagcataagtgcttgcttgcttgcttgcttatttgcttgtttgctttcttcctcctcctcctttttaaaacagggtctttccctgtagccctggatgtccggaaactatttatataaaccagcacagcctcaaaactcaagagaccagcctgcatgctaggattaatggtgtgcgacactttaccttactacaaaagtgcccataaccactgagaaacctctccagactccaggaaaaaaaatattaattgtacaggaagttattagtaatccttattttctttctttgtatttttctgttttccacaggaacaggaattaatcacttttattttaaaaaaaaaaaaaaaaaaaaaaaaacaagaaagaagtgctttggagccaggcgtggtggcgcacgcctttaatcccagcactcgggaggcagaggcaggcggatttctgagttcgaggtcagcctggtctacagagtgagttccaggacagccagggctatacagagaaaccctgtctcgaaaaaccaaaaaaaaaaaaagaagtgctttgggctggtgagatggttcagtgggtaagagcacccgactgctcttctgaaggtctggagttcaaatcccagcaaccatatggtggctcacaaccatctgtaacaagatctgactccctcttctggagtgtctgaagacagctacagtatacttacatataataaataaataaatctttaaaaaaaaaagaagtgctttaagggggaaataaaataaaaataaaatcaaaggcctttttataaaagaaaaacaaaaacatgatttttaaatctgcggttccccatttgttcaaaactgaaagcagaagtcttgctgggtaggtggagcaggccagatagcagaaggtgggaggtggagataagaggataataggtttgaggccagcctgaactatagaatggaaagagcatttcaaatgcaagtgttgaagacctaactcaggctggaatgcttgccccgggagcaaggcctgtggctggaagctgcaggactgacctggacacaaaactgcttccccttcccaatccttcctcctaggcttcctttcttaactttttgttcattttactttctcagtgaaattatcctaactaaaatataaactccagtgttaagaataaaatgtagtaccagaacacttaccgagtattcaggaagccctggaattgatcacaaacacacaaagagaaacaaaaacagacagacaaacagacagacctcgagttgaagggacagtggaaatggctgggatcagccagtttgaaggcaggcatttcggcaagcaaggcacggaaggtaaagatgcagttaacagtgagcagcagagggcaggggaggttgacagggaagccttcaggccagaagagaattagggtgaggagaaagggataaatggttgaaaatgtagaatatgtagagagggctggaaagggaagtcatgaagaggtcagaagacaacagaatctaagaaagagatgagactcaacagggagaacccaatgaccagggtagaagcctgctccagcatagttattccggtccagaaacagttacttgcgcattaatatggctttatctctaagctggaagcaactcaagagtgtgaagcacatctgttatcactcaaaccctcattcctcactggagaagcacgtgtgtccttacagtttactctgcagggcaaggatctggttcattgttgttttggaggtattttgtttgttttccactttgtattctgtattctcttgagactaggtctttactatgtaacactagctgtcctggaactgtaaacaaggctggcctcaaagcaatgttaatcctcctgcctcagcttccctggcacttgggaggcagtggctggtagatctctgagtttgaggcctggtctacagagtgaattccagggcagacaagttagaactacacaggaaaaccctgtctcataacacacacacacacacacacacacacacacaccccaaaaaaaaaaaaaaaaaaaaaaggagaagaaggggagaaagaaagaaaagagttgtctagttaaaatcagcaaggtggggtagctgaaccccccaagcttcaggccaacctgagcagtagagtgacaccatctctcaaaagtaaataattaagtttaattcataaagggtggctggccattcctcaatggcactctgccttgtaagagatgaagcaggacaggcttaggttacagtgtatcttgtgatctgctcttccatacttatcttggtcaacttacagaacctgggcaaatggggtgacctgctcacttgagtctaaagaatggctaacttcaggaggaagcctgctgatcttctactgcactaacagggacctgcataagctaatacattgaatagtttctaaattgtagcaaatgaaacctggatctatccgaacctttatgttttacttctctgagcattttacacaaaataaaattctataaatttatataaataaaactattaaaaaaaactgttgcagcagatgtattattgtaagtccactataatcaaaatcgtttggaatcgtgaaacgtataaataatttccaagatcagcctttccaacagtgtctccccaggcaaccctagagcaagcccagcccctaggacgggcagctccgcgctgctcgcaggagtggcagatgccatttctcgctgacaggagcttcaaattccagtcaggcaactgcagtcacagtcccactgaatcaggaatataagcgtgcctgcatgttattatgggaaatagtggaaaatttcacaggctgacatccagaacgtctgcggctccttttcatatttcttcctgcgaagcagttattagaccagtcaaatttttttaaagctggaaatttccactgttcttttttaagtatcctttttagatgtaaactaaaaactgttccaaaattcaagtatgtcaaaaataattcagataaaataactacttaagtgaagggaacagtaaaaaacctggggtctccatcacctttgggagagagacacatccattgagacccgcagaagcttaaaggtacagtaacttaatatgaaggctacaatgctacaaacactctgagatgctgattttctcatttgcatatgcctcaagcattcaaaagctaacataagtcagtagacagtgaagtagaacccatgagacaagaccagcattgtggcaggagcccttagtcagagctgctccggaggcccaagcaggcaacaacatcaagaccagcatggacagcaagatctcatcacaaaagggggtagtaagatgcacatctctttatagaaatacattcttcacatccatatagcccatatttttagggctagcatgtacctactctgtgccaagggtctgattcctagagctgagtgtttccagcatggagaggaaagcacagcagctgggaaacacagctcacttggcagagtgtggggcaagcatgacgccttgggtttggtccctagcatcacatcgaaaagccaggcatggtgattatgccagaactcaggaggaggaagaagtctccagatttaaggccagcccacaggacatgtgacatctctcaaaaaaaaaaaaaaaaaaaaaggtggggattctgttttatttgttttcttgattttaagggaatataaaaaatcataggcaagacactctttgcagtggcagaggcaggccctgagtttcgctcctggaacatacactgagagccagtgttttagacaggttttcagcaccttttcatgagatcacactagaacatatgtaatactatacattttaacttatattggggaggaaatagacaaagattatttttccccctttcaaacaatggctcatgcagtccaggctggtctcaaattctctcactaggtgcagaggatgaccttgaacctctgaccctcctgactcctccctctcagaaagctggaattaaagcctgtacctcccaaacccagttcctgcagtgctgagcatccatccccgggcttcccgctaggcaggcactctaactgggctacatcctgagccagacaaagacttgactcattttattaaagggataaaaagactacattccaaaccattcaaaaatcaaagctgacttttaacagtcaaatgcactaactaataaggtctgcttaagatgggctgggagatggctacataggacaacgcatctgtgacgagctatgagaacagagcttaaatccccagcagctactcagaagccaagtgtgcagctgagtgtgtgtaaccctgcacgcctaggggaagatgggagacaagacaggacaatccctggaagctacaaacaactagtcaggcctgtacagtgggaaagaacaaaggacctcgcttgaagcaaggtggcctttgacctccacatacatgcatatatgcacacacaggcacacagataaacctttaacctttacccaagacaggggacgatggtgcacacctttagcaggaggcagaggtaagtggatctcttgagtgtgaggccagcttaggctatatagactatatagcatgttctgggccaaacacagctgcaaaatgagaccgtttcaaaaaacaaacaaacaaataaacaaaaaactgtggacatgtggtatgcttgtaattagagcactcaggatgccaaggcagatggacatggcaagttcaaggctagcctatactacatactaagatctacactccctcccccaaaactagcaatatattatgcttgtataactttttagcttaaaattttaatgacttatttttatttcatgtattttgcttgcatgtgtgtctgagtgagggtgtcagatcccctagaattggagttagagacagctggggggtttcatgtgggtagtgagaattgaacctgggtcctctagaaaagcagccagccctgcttatataactttacagaccatccacacacagcccagaacttgaacgtatcatacatactcctgcccatcagttaaaagctactctaccactgactcaaaagctacatcaaaacacccagctactccttttgaaaccttgctttttgtttcacaggccatggaagagataaccttaaaagtgttcctatagattatactttcatacaggaatgatagaggtaccatgaatctaggttaaggtccttaattttgacagaacgtattttttcctgagacaaggtttctctgtgtagccatggctgtcccggaatttgctctgtagaccaggctagcctctgcctcctgactgctgggattaaaggcatacaccaccactgcccagctcagaacatttttttaaagttttttatttttttttcttttaaatatctgttctgtatgtatgagtgtttcactcatgtgtatgattatgtactatgtgtgtgccgatacctgcagagattagagcaatggatctcttaaaactggagttacagatgtgggtactggaatggaaatcaggctctctgcaacattaagtgccaggcatggtactgcacttggtagggagaggcaggtacatctgagttcgaggctagcctggtctacagagggagttccaaggcagccaagctacacagggacgccctgtctcaaaaaatataaataaataactattaagtcaaatcaggtacttgtaactgctgagccatccctcagccccttaagttttatatgtatttgtgtatctgtgttatgaacagtcatgcatttgtctgaataggccaaaagagaatgctgacccctagagccggatggagtcgaaggcagcgtgggcactaggagttgaactcatccccaccaaagcagcatgtactcgcaacctctgagccatctctgcagcacttcataaagccctaaccctgacgtctgggcagttaattttttattgctatgtaatctttagccagcccccagagtctgtctaattggtcagagccctttgggtcagcccctggactgctcaattttgatttgatcaccagggtggtgtggggagggcacaggacagatatgaacccaagatatgaactctgatttcttagatattctgctactgatttcatggatcctagatgatgatcagaaaacctaaaactgcagcttccgtttacctgtaaattgagaacaaacaggactgaaagctacttggcaataataaagaatagaggggctgaagaggtgacttgggggttaagaacactgctgctcttgcagagaacctgggtctgtttcccagcacccacggtagctcacaaccatctgaaactccaatcccagggaatttcccctggccttttctagcctctgccaatactgcattcacatgaacaaaacactcatacatatcaaaattgaatcaataaataaactatatcgatggctcccaagattaaactctagcccccatgtgtgtgcaggtatgcgcggggagtgaagaaaaaaaaaaacaaaaagaagaattttgaggtaaaaggaatttaaattaaatcagaatgagattcccactacacatccaccagaatggatacagcttaaacaaatattaatatcaggtactggtgaggatgtgagactgaaaccggctatacaatggcatagcctcttctgtaaacagtttcatagtttctgaaataactaaacatacattttgccataagatcaacaattctacctcccaaaaaagaaagctttgtgttctctctcaaacttgtattcaagtttactcagcattactcagaacagccaacaggtgaaccaataaaacagtgcttgaatggtaagtaggtaatcacatatacacagaatatacaacgacagaactagtctgtggaacagtatgggtctcactcagtgtggaagggcagctcttgcctgcatggcgccaacaaccaccagcaatccagcacagagatgttatgaagggaatgttatgttatgttaagttgtactgagacaaagcaaagggcccagggagcaacactcataatccaagcagagggaaacaggaggatctggaactcaaaagcagtcagtctagtcacactgcaatgttctggcccagtttaagatgcacagcaatagcctggcatggtggcatatgcctttaatcccagcactggagaagcagaggcaggtgggtctctgtgaatctgaggccagcctggtctacaaagttgagtccaggacagccagggctactacagaaaaaccctgtgtaattttaatgtagttaaaaaaaaaaaaaaatcctttctttttttttttttcccggagacagggtttctctgtgtagtcctggctgttctggaactcactctgtagaccaggctgggaaacaccatacctggcatattttataaaattacagttttgagtaacattgctagtgtagagaaacacaatagacgtgtgtgtgtgtgtgtgtgtgtgtgtgtgtgtgtgtgtgtgcgcgcgcgcgcgtgcgcgtgcacttataaaatctaatcctattaggctcaattttcctagatgcgttcatgtagtttgtttaggatggaatactgtatattgtcatttctcatcaattctcccaatcccagcagggttgacagaggaccttgctgtgtatcttgttttctgagactgggttgaagtaaaaattaagggttctttgggaattcagttatggtggatggtgttttgctggggcaataaaggagtgttttcctgaagtggacacaggtgaaagactaaggtagactaatgaaagaacatttaggtaaaacagacacagaaagaaagactttctgctaaagcaagcacatgaaaggacatgtgatgaaggattctttgctaccaacacacttgttgagattccatagtgaaaaacgcaccgccgggcagtgcatgcctttaatcccagcactagggaggcagagacaggggggtctgagttcaaggccagcctggtctaccttgcaagcttgatgaaatcaagggctacatagagaaaccctgttttaagccccaccccactgtcccccacccccacccccaaaaaaaggctcaagaccagcctggcctacaggagttcgaggccaaccaggaaccaggaataaataattgagacaaaaaaccccacaaaaacaatttttaaaaaggaacttgggccaggtggtagttggcgcacacctttaatcccagcacttgagaggcagaggcagaggcaggcagatttctgagttcgaggtcagcctggtctacaaagtgagttccaggacagccagggctatacagaaaaaccctgtctcgaaaaaaaaaagaaagaaaagaaagaaagatagaaacttggaagctgttgtgcaactcagcaataaagtaagtccttgtcggacatgctttggggtccttgattcaattctcagcaccatacacacacacaccaagttcatgagagggaagatataatatctcacatacctttgtctgtaaaataggggcttaagtaacccagcctagcctaccctaaaagtcactatgaagccaaggatgacctagaatttctaatctacttgcctctacctcccaaacactgggattaaagtgccaatatatcagtttgtttagtactagggctggaactcagggctttgggaatgctgggcacttttatcaattcaagtacatacatccccaactctatcctaaaaattacatgaaatcctaaagaatcttaaaaaaaaaaaaatgaaagaaagaataaaggtggaagatttagatctaatttcaagacaatatctaaactgtgtggggctgggatgaggacacatactgagaaaggacaaacacagaagcatacccatggggttgacatggcaatacacacctggaaaaccagctctcaggagcctgaggcatgcataggcattgagttcaaggccagcttggtctacatgacaagttccactgcagctagactgtctcaaaatataatgcccagcatgtggaagcctacgtgtgtgtacccttccctccctccctccctccctacttacctcttgtgtgtgtgtgtgtgtgtgtgtgtgtgtgtgtgtgtgtgtgaaattctattgataactgatctcctaacattaagaattttaaccctacaaataccaaagtgtggacactttgccccttcttagaattgggaacaaaacacccatggaaggaattacagagacaaagtttggagctgagacaaaaggatggaccatctagagactgccatatccaaggatacatcccataatcagcctccaaacgctgacaccattgcatacacaagcaagattttgctgaaaggaccctgatatagctgtctcttgtgagactacgccagggcctagcaaacacataagtagatgctcacagtcagctattggatggatcacagggcccccaatggaggagctagagaaaatacccaaggagctaaagggatccgcaaccctatagatggaacaacattatgaactaaccagtaccccggagctcatgtctctagctgcatatgtatcaaaagatggcctagttggccatcactggaaagagaggcccattggatttgcaaactttatatgccccagtacaggggaatgccagggccaaaaagtgggagtgggtgggtagggggtgggggagagggtatgggggacttttgggatagcattggaaatgtaaatgaggaaaatacctaatttaaaaaaaaaaagaaaaaaagaaaaaaaaagaattttagcccttccaaaagttattttataagacaggccatagactccaagaaactatttgtaaaaagccaacaaaacttttggctttatgggctggagagatggctctgaggagtgagtactggctgctctggagagaacccaggatcaggcccagaacttacatgctacttcacaactgtttccaactccagttccagggaatcagatgccctcttctggcctctgtgggcaccaggcatgcacttggtgcacagacataaaggtaaatatactcgttaaaaaaaaaaattttttttatttggttttttttttttttttggcttttggcttttggagacagggtttctttgtacaggtctggctgtcctggaacttgatttgtagaccaagctggccttgaactctcaaagatctgcctgcctctacctccctagtgctgagattaaaggcatgcaccacgaccaccaccttccaacctcagaaaaatgtcctcaaaacaaaaaaaaatttaactaatacttgaaactgcatctataagtgtggaaacttttttaaatgtgggggttgggtaggagagttgaggatcaaactcaagaccttgagattgatatgcaaagtacaccaacacaaatctagtttagttttttgtttgttttttccaaacagggtcttctttcctttatcccttcctgctttctattgttcacctatttgagaaaggcagtgaaggtcaaagggtaacttatcggtgtcagttcttcccaccacgtggggtcatcaggcttgccaagtgcaccgagctacctcaccagacaagatcttaatagcatcctaggctgaccttgaactaaagatcctcttgcctcaacctcttctgtttgcttgttaaatttgtctaacttgtttgtcttcgtgtatgtgtgtgtctgtgtatgtgcatgaatatgaataattataaagacagaatagcagagtaaaaagatctaacaaagatgccctggagctggacttagagtagttgtcagtcatcagcagccagaactgaaaatcaagctcaggtgcctgctaccgaggtcataggtgctcaatcagctcagctttcttcttactttttgttaggatttggtttggtttgtttgtcaagccagggttttaatctacaacatacacttgcttcaaattttgatgatcctcctgcctcaacttctcaaatgcagggcttacaggcatgaacccccacacccgacctaggaaaccattttccaactttacacagccacatctacaacagcaaagtccctaaggtcatgggccctgagtcccatcttaatttctaatgaaaatcatttgtaaaatatggtaatactctagtctgggaaagcacacctctgaccctccaaggtaggcaaggtacagggagttgtcctccagaggaatttggctttcctagttgctgtcaaacaggttccaacagcaggggaaactttggctgggataagaagagttgtgtcattaaaacacaactatcagcagagtgtgttggtacaggcaagcagatcaacgccagcctggtctggggttccagggttacacagaccttgtcaaaaacaaaaacaaaaacaaagccctacaactagtcaaataaaagaggacaaaccagcagtggcccataaactcagcactggggttctcctgctacacagcaataaactccagccctggccacaaaagatcctcccacatccccatctcccccactggacagcacacaccacgtaggtccacagcttctagggaaaccttcatagtaagtcagcactaagagctgtggctaagtttacatcatctgacaggaagagctgatgtgaggagttggtggtatacacatgtaatcccagcacttggaaggcagaggcaggaggatcacaagatggaaatccacccattctagatagaagtgccaagccctacaaggccctgtttgaaatataaaaaataaaaacaggagcttggcagggtgtccctatgccatgtcatagggacggtcgggtatacaggagtctcaaaagaaagaacggccctagagagagactgccaaaagcatacagggtattgaactcttcaccaccagaactctcctcaaagtgacaaaggacactgctcccgacagcagcaggaggaaaacactccaggctttcttacgtgtatccttgtcagttgttttgaaactgaggaagggatcctgcggctcttccaaatagcagttaacttccattataaaaaatgtcagtttggaacagattatgagaaacaattgttcttaaataaaataatttagtcttggatttcagttgagcagagagttcgattttcctaagtgatgcctttctctccctccccgggctttctcctctattgtattgaagctctcagatgccagagatggaggaacaataccacaacacagctgcaggcttcctgcctgcccgccagtcattattctcaagaccagaggactttcaaacgctgcttgggttgctttgaaattccctctttcagatttccctccttcatggaccatctactgaaaagaatggcctcaaaaatgtcttactgcaccaaccaaaattctaagcaaactgaaagaaagtcgccagccttgggtatgatgagctacaaatagcttggtaaaaagccagtaaaaatgtacataacaggagggaaaaaatatttctaagcacaggatagattttttttttctcatggatatattaaaccagtttctggggggggggggaatattcaaatttatatcaaaattgtcaacattaaacactgaaatatcaccatcacattttaaaagggggaactaccaagtgtctcaaactatgaaaaggccaaggcgtcccttcttagacattttacaccagaatgaaaggcatttacgcatcttaaagtttccgagaacagaacagattaccagcaatggcctgccgacctggagtctcatttcctctgatcacgttttaaatgtgggacactcagtcaaatcttaccacactgctgagctctcccagtgaagagactcaaacacaggtggttaattttctccccagcagaccatggacttttttttttttttttttcccctttgtccaaaagcattaaatggaagcttggggagtaacagcttgtcaaactggtaaaatgaacagcaacttcccaagttacttgcagaactgaaaaggaccaataacatctgataaatccttactctattacaacaaaatatcagtcccctgaagtttagtgcagtggaattcaacctttacaattaacattcaactgggcatcaggttcatccacgtgaggacagggtggacttctgaagcccttcccgtccagcatctgtgcagcccgggccaggattcccttcccaccattctagggataaccaagaattcagtattacagagaagctcacagccagccgcctctgaccaaggaagtcagacctctcaacgaaacagcagtatagaatagtctgccaaaaagtcacaccttttcttgaatccatcacagagaagcaaaacagaacacagataactacctggggtggggaagatactagctcatttgctctgagaacttttttttttccaagatatatttggtgagactccttaccctgcctgtagcccacatgactatggtatggttagttaactaagcctttataactacccactgtaaactgacctagacagcaattcctaccaagctaaatgaatgccgacaaactggcaactccatttgcaggccaagcagattatctagtgtgtgatgagccagcctcactgactcctgctgagcatcttcgggaccttttcctgttctttaacaactttccaacagagataggaaaagcaaaggtgataaatcaagtcaattccatcatttgttgggagatcgaaaacaggttagagctgtgaactgaataaatatggtcttaggccaacaacaacaacaacaaacccagaagccccctcaggaaacaatggatacatatttacctaacagtaactaaggatcctccaggtccaccgaggtcctcctccacactaccaattctcccaacatgtgctcaaggtgagcgccacatttcactgcagcaccacgtctcagaactccctgcaacccagtcacatcctttccaacactagagaaatcactgtgtggttcccagagctctagccagtgaatacagcagagattacaccatgctcctaggtatatattgtggcccaaaccagctggttcagcgatcccttgctcaatggatggcaggcaacaagaacaactcttgtttttccaatcccaggaagtctcagcagagtaagggggtattaaatgtggccaatttgctatgtagacaaactgccactggaggcaatagtcattctaaacttgcaacaacttaaaagtttcaaaagtacatcctctggcagacaattaaaattacagagtttttaaacgcaaagagaaacaaaccctaaagtcaaatacctcaacaaccaattagagacaggacagcagcatttgggtttccctgttttacctaaccctattacccaggctaaaaggcactctgaaatagttctcccacagccgttttcaacttaatacaactactctggagccacacagccatggcacaggagactgggtggaaatgtgctctatgtcagtgcaggtgcgggctttccaaggggtaccccattaatgagatggagggacctaactcaggttgttaggtggtccaaaacccttaaccattgagccatgactctaggccaaagactgaattttgtaatttttttttttgttgttaatagaatgtccctgacatagcaagaagctataatttcaatgattcaaaatgggcttcctggcacatgaactcacaggcacgtgcgtgtacacacacgcacacatacatttaaaaaaaaaaaaagttgttgggattggagaattggctcagtggttagaagagcacttgtttcttttgcaaaaggtcctaggttcaattcccagctcacaaccgtctataactccagctccagggaatcaagcaccttcttctgacctcagcaggcactgtggtatatatgcatgcacagagacaaaaaatatccatgatgcataaagtaataaaataattttaaaataatttgtaatttcattccatttcttgggagacaaatgcagaagcggcactataagtccatgccagcctggtctacacagtgagttacaggccagccaggaatacagtaagatctgttctcagggagaaaaaaaaaaaaatgcaaataaaaacatggatcatgcccggcgtggtggcacacgcctttaattccagcacttgggaggcagaggcagggggatctgatttcaaggccagcctggtctaccttgcaaggttgatgaaatcggggggtacatagagaaaagaaaccctgttttaagccccagccactcccccccaaaaaagaaaaaaaaaggttcaagaccagcctgacctacaggagttccaggccaaccaggaactgttttttgagacacaaaaaaaaaaaaaaaaccacaaaaacaatttttaaaaaggaacttgggccaggcggtggtagagcacgcctttaatcccagcacttggggggcagaagcaagcagatttctgagttccaggccagcctggtctacaaagtgagttcaaggacagccagggctacacagagaaaccctgtctcaaaaacaaaaacaaacaaacaaacaaaaagaatgcattcatggggctagagagatggcacatcggttaagagcatggctgctcttccaggtcctgagttccagtcccagcacccacacggcagctcacggccatctataaagggaactgacgccctcttctggcatgcaagtgtacatgtagcagagcactcatacataaaataaattaaaaaaaaaaaaaaaaaaaacaaatattctttttaaagggcattagtgggggctggagacatggctcagtggtgaagagcactgactgctcctccagaggtcccgaattcaattcccagcaaccacatggtggctcacaactatctgtaatgggatctgaagccttcttctggtgtgtgaagacagctacagtgtactcacatacataaaataaataaataaatattttaaaaaaaaaaaggcgttagtgctagaccacacacacaaaataggggaaggacctgcagaaccaagttggaagctactctggtctatatcataagggaaaaaaaaagataatgaaggccttaatgggctggagattcagttcagttacaaaacacttgccaagcatgcatgaggccttaccttggggctcaatcccagcacccaagaagaaaataagatgttgtaagtaatcacttcaaacaagtattttcttcacacactgcccagagagaggatcccgggcctcagagtgcactccctccttaataaatgagttcatatttactaagagggtggaggtgccctacagaatttttataccagggaaaatgcatcctaaagtcactttcgaagcataatgaaattagctaggggtgtgaatcagcacacatttaaaaaaaatagctcaggggataagagcactggctgctcttgcaggggattcgggaatccaagcaaccacatgatagctcacaactgtccataactcgagtcccaggggattgaaagcctcctcaggcacgaagcacacatatgcgcagacatgtatgcaggcaaacacttatacacataaaatataaattaaaaatttttgttaaagtcagaaaatatttaatataatccctgataacctagcattactatcatgctggggttttttctaagattatttcctaatgtatgtgtgcctacatgagttctatgtcctccacatatacgcaagagactgtggaagccagaagagagcatgaactgagacagccagaactgaagttacagatgggtgagcagcctcgtgggtgctggcaagggaaccaaagtcctcctgaaaaccagtaaggtctcgtaaccactcagtaactgtaatgaactgttagtattttttaaatattacttatttttattttatgtatatgactgttcactatatgtatgtatgtgcagcgtgtacagaagcctggggaagacataagggcactggatgccacagagcttattaagtttgaataggttgtgaccatgtggggactaagaaccaaacctgggtcctatgagaagctgcatgggctcttacccccggggccatctctccaactcctctggagtaatttttaaaatcattctagcaaaacaaagtggaacaagccttcattctcacttgagaaactgaaacaggaggctgagttcaattgaggccaacctagctgctaaactaattaacttcatgattcagaggcttacaaaaggtaataaataatcctgaggtgtcataagtctctaatcccagcatctgaagggcgaggcaggaagatcacgagttcaagaccaaccagaaatataagctccgggttccacacgggcctgagcatctcaaaacaccaaagacgggatggagagatgccgggttccacacgggcctgagcatctcaaaacaccaaagacgggatggagagatggtggcgtagtggtttaaagcacttgctacactttcagaggaccagggttcgaatatcagcatgtacatggcagctcactatttgtaactgaattccaaggaatctaacattctctcctggcctccacagacacaaggcacaggcaagatgcggtgtaccaaccaacatacacacaggcaaaacacacatacatgtaaatttggggaactggctatatagttcagtggttaggagcactggctgtgcctacagagcacctcggtttgattcccaacaccctcatgatggcttttgtttgttttgcttttattttttttgaaacagggtttctctgtatagcactggctatcattctgtagaccaggccggcttcagagatacatctatttctgccaccagaatcctgagattaaaggcatacaacattatgtatgccctactcacaaagcatccttaaattcagttccagggatctgacagaagggattctcttctgaccttttaagcaataaggatgcacatgatgctcagacatacatatagacaaaatactcacacacataaaaataaaataatctttaaaaaagacaatcttgattatatgctgaagtttgtgttttgaagtcctctttaaagggtgttttctgatgaaaatgtcctccgtaactgcttacaattagagctgccccttttgcctacaatccccagctataaaatgtacttccttctatatgctgaaagctagcatgtgcctttttgttttttaatgctgattggacaattaagtcttttctatcaacatataaaatactctataatttgggatcacaggcagtttagattactgctcatttaaattcagaacctgaagctacctccagcaacacaggagctacagtggtcggtatcactttacatgttacaaacagaggcttcatcttacaatgaagcctcagggttctacatcccacagactattatttctttaagggttttaatacagcaaacagcagtagcactaaattcaacagcctaacaactattgagattttttaaattcatgtcaatcagtgcactaggtggatgcctgatgtccacagaggccagaagagggcgaccgatcccctggaactggagccatagatggttgctggatgctgcgggtcaataccaggtcctctagtagagcagtaaccaatgttcttaaagctctgagccatctctccagctcctgcaagtttaaaatagcaaaaaaagaaaacactacccctccccagcccccgttcctgctctcagtatataccagctggggtttgtttctaatgaaaatactttagtctttagttccaaagccaaacttactgcaagaaatgctaacagtcattgccacagacagggtttctagtggaagagattcctttttcagtattttcagaccttttcagttgggtatccgatgtggaaaaaacctattctgaatacttgataaccatttaaggttttaaaagaacaaacggctcacaaactcagaggtttgcactgccctgttagtccacagccgtatctgctgaagatctgaatgcatgcacccttagctccagcaactcatttctgcaacaacctgcaggaacaaatgctgaggctttggcgcagcagagatctgtcaaccaagccgagggtccccgacatttaaatctcagtccagaaaccctgatacaggacctctcatcttattcgtccacctagcccttcagcagacaggggactgactcgccttcctggtttttaacctcacaagcttaattacaaaaacaagttggctttgaagcgctactcagaaactgcaaccaaaaaaaaaaaaaaaggaagtcttcgcatttgggagggggaaaaagtttctcgacttaaagacactttccaaccttccagtgtcatacagtgtggagtcctaggctcctgctccgcgggcctacgatgctctggcctctccgagctgctctcctgcttaacttttccaccctagccaccctcaagctgcctagggaagtagcactgcctcccacttcatttaaactactgcaaacagaatcaatgaacgaacctagactgggaatttcagaagatgaaagcgacctcgatgatagccgacacaagacggcagagcccctatccacgccgcacagagagggagagaccccacactcatcccatacagacggccgaccctgcatccacgctacacacacctcggactcctcatccgccaagcatccaccctggagacatcgcggaccccgcatccacccggtcctcgccccgcacagaccgcagaccttgcactcacccctcgcacctccactcacccggcacacaccagcacacacctcgcacaccgcactcagctccctcgcccagcatccaccctgcagacccccacacgcagcctgcatccaccccacacacctggcggactccggggccacccaacacacctggcacaacccgcagacccccacatccatgccacacaccccgcacacgccacagaccccactctcaccccgcacacaccccgcgggcaccgcacactccgtgtccgccgcgcccgctcgcagcggagccgcagcttcggccggaggagccgcccgtgtccgctccgccgggcggcgccggcgggaagaggagactcggctgagcttctccgacccgagattcggcggggggagccccagcggcaagcagaggccgcggccgcgaactcctcgcgaccctgcacgggccccggagcccagcgccgcccgcgcgatccctgtcgcctgcgccgcgcgttactggcgaccccaggacccccgcctcaggccatgccgccggcctcgcccgccgctcgccactgcctttctctccactcaccgctcgccgccatcttccccaacgctgttctcgatcggaaactcacagctcagccccggccgccgacaccgactccgccgaggccgccgccggcgctctgaggagctgaggcagccgccgctgaagccgcggcgcgggggccgccgggatttgtagtcccgcggccacgcccagcactacgggtcccagggggccgtgcgcgaggcagggggcgtggccgcgaggcctgggttcccctcagctcacccagccgctggaggtgaagaggacgttctgggttcgttttcccgtttgcctgtctccatcctggaattcctgacttcaatggagtgttcattgtgcgccaagcaccgtcccacaagaccagtagctgagggggcgttgtccttacttttcagaggagcaaactgaggcccgaggtcaggagccctgctaagtcactgacttgaaaaggtttcgggccttgcggtgatggcacacgcctttaatcccagcactcaggaggcagaggcaggcggatttctgagttcgaggccagcctgatctacaaagtgagttccaggacagccagggctatacagaaaccctgtctcgaaggaaaaaaaaaggttttggctcacaaggtgttggtcctcaggtttggtctctgcgtattgtgatttaaaccagagaacagcttgctttacagtgggaattactgagagacagcaccttaaccaagaacatcttaaactcggtgccaccaaaggtgactcaaactgtcacgccatgtccccgataggatgcagtgcagaaagcagaaaactaccaagttaagtgacctgaatctaacggaataggaaaataaataaataaataattttttaaaaaattaaagcgcagaatgtgcagcattctacagaaccagcctctcctccaagaaaaccgatggtagcaagtgaaggcaatcccagtgaccccatggctccggggcagaaacagaagaaacaaaaactcaaagtcctccttcaaagcagggatttaaagccaagttggggatgggggtgaggggagtctgaccaaaataaataaggccaaagttaaattcaataaatgtaggccaggctagactccagtttagaaacctggctgcctctgcctccctagtgctggattaaaggcatgcactagcaaccccggtttatggatagttcttaggtaaaaagaacttgtaaaggaatttggagttaatgggaaaaaatagaggacgtcttgggacacaactgtataaaatgtcttcagtgtgaataagactaaccctatcctgaggttctgctgtcacctcaaggatttcccacctgcactactttactgttctgcaagtgtccactgtttacccttggagttattcccacagcagccaagtcccaaacctggtgtggtggtgcacacccttaatccctgtactcagaaggcagaggcaagtggatctctgagttccaggccatccagggctacatagagaaatctaatcttaaaactaaaaatagtaataataattctaaatgtaacaaaagtacattaaaataaataattactgattcaagcacagtactgtactaaaattttatccatattcagacatatacataatctttatatatgtatatgttgagagcataacagatatgaacagtaaaaaaataattcaattgtttcagtaaaagatccaaaaagaaggcagacatgccgctgctttgggtggggtaagcaggtgaccctgcaacagcatctggccggtgctagagccaaaatttaaagtagctgattgacttgctcaggtagataatcagcgaagatgctgccttcatccttcatccttccctgtttgcccagaccactcctccatgaagggattgacttgtgtcccttcttcgaattaggcttggttctaagactgttgccccaaggaaacacaagtcacaggcctagagcttgagaatgctgccagctcctacttcctccttcctggccccaactctagctctatgagaatccagagggaaaggaagcaccagttgacagaggctgaggtcccaggcaagacccaacagcagctgccagccctgcacacagccttcttgtacgtccctgtcctttgagggccccagtgcttacatcaccaacaagattagcaccagagctaggcctggtaggacacacctgtaatccttccatttaggaggtaaaaggacaaaggttatcctccactatgtctgaaatcccaggccagcctacacatggtatcctgcaatcccaggactcaggaggctgaggcaacaggattgtcaagaggacggggccaggcatgcagggccacccaataagagcctactggaaggaagaaagatggagggagaaagggaggaagagagaaaaactagttcaaattccaaaaaggaatgtattctactggccacattccatgttgtagatgtaaagaacagaccaccagggtgacttttaaaaacctaaggaatacaacttgtcgatcacttgactgagatgaaatataaaaccatcacagaaggccagcacatgggtcagcagatatagtcccttgccatcaggcctgaagagtgaggtctcagaacagaaggagagaaccaaatcccccgaaagctatcttccatcctgtaccatgtcatgccccaccctcctccagaaaataaaggtgatcataattctataagctggtgggcttccctacaatttactctcaaatgtctcaaagggaaaaaaaagtgctggatggtggcaagggcatgtgggggcaaatgtggcattgtgaatagattttcttttagaacactatgtgggctaattggttttgagggtttttgtttttgggttttgttttgttttttgttttttggttttttttttgttttttttgttttttgtttttggcaatttgacacaaactagagccatctggaaagaggacaagtgagaaaaggctttcatcacactgacctgtagacagatctgtgtctcattttcttgattaatggttggtgtggcaggcctaggccctgtaagggcagtgccatccccaaacaagcagttctggggtgaacaacccagtaggtagtgtttctccatgtcctctgcttcagttcctgccttggcttcctcggtgatggaaatcaacccttttggtcctggtgttgatcccagcaaatgaaagccaactacagacagatacacaggcctttgcagctttgggtgctaggattgaaccagagccttatgcaagctacgtactcgctctagcattttgagctgtaccctcaacccatgtttctcatagactttcagattttctgtagactcggaacatttccaaagtaggaaagttggttgttgtgggacagggaggactcagaactcacagagcacttatatgttccaagtactttgggggtttatttttgttttcttaatgggtttgttttgttttgtcttgctttttgttttattttgaggctgggtcttaagctgccgcccaagctggctgcaaactcacagccgtcctcctgggatctggagggcagcagcacacccagcttttcaagagctttttgtacttcctcgcccccattcatgtcatcgctgcacgaatgctgatcacaccccatttcagagaggagtaaatggaggcttgaacaagtcagtcacttgaccaaggacagacacctggccaaacccccaggctcttccacgtcacacctcttcacctctgcacaagtgacagagatctctaacagtcttctggactggagaatccctggaggtagctcaggtcttgaccttttgactaaaatcaagagtagcaatggggcaggaggtgatggcacgccactttagttccagctctcaggagatagaggcaggaagatctaagttctaggccagcctggttcacagagtgaattc

SEQ ID NO: 25 - DNA, 29 bp, Artificial Sequence
  synthetic primer
gaaaagaggcagattcacgtcgtttccag

SEQ ID NO: 26 - DNA, 28 bp, Artificial Sequence
  synthetic primer
atctggtgcttcttttgggatgcgggag

SEQ ID NO: 27 - DNA, 13 bp, Artificial Sequence
  siRNA coding sequence
gctgcataagtgc

SEQ ID NO: 28 - DNA, 27 bp, Artificial Sequence
  siRNA coding sequence
  misc_feature 14: n = A,T,C or G
gctgcataagtgcngcacttatgcagc

SEQ ID NO: 29 - DNA, 33 bp, Artificial Sequence
  siRNA coding sequence
gctgcataagtgctttttgcgcacttatgcagc

SEQ ID NO: 30 - DNA, 21 bp, Artificial Sequence
  siRNA coding sequence
aacaggtttcgaacaaacaag

SEQ ID NO: 31 - DNA, 43 bp, Artificial Sequence
  siRNA coding sequence
  misc_feature 22: n = A,T,C or G
aacaggtttcgaacaaacaagncttgtttgttcgaaacctgtt

SEQ ID NO: 32 - DNA, 49 bp, Artificial Sequence
  siRNA coding sequence
aacaggtttcgaacaaacaagtttttgccttgtttgttcgaaacctgtt

SEQ ID NO: 33 - DNA, 21 bp, Artificial Sequence
  siRNA coding sequence
aagcttcgaattcacaagtgt

SEQ ID NO: 34 - DNA, 43 bp, Artificial Sequence
  siRNA coding sequence
  misc_feature 22: n = A,T,C or G
aagcttcgaattcacaagtgtnacacttgtgaattcgaagctt

SEQ ID NO: 35 - DNA, 48 bp, Artificial Sequence
  siRNA coding sequence
aagcttcgaattcacaagtgtttttgcacacttgtgaattcgaagctt

SEQ ID NO: 36 - DNA, 20 bp, Artificial Sequence
  siRNA coding sequence
aaagagccatctcacccatt

SEQ ID NO: 37 - DNA, 41 bp, Artificial Sequence
  siRNA coding sequence
  misc_feature 21: n = A,T,C or G
aaagagccatctcacccattnaatgggtgagatggctcttt

SEQ ID NO: 38 - DNA, 47 bp, Artificial Sequence
  siRNA coding sequence
aaagagccatctcacccatttttttgcaatgggtgagatggctcttt

SEQ ID NO: 39 - DNA, 21 bp, Artificial Sequence
  siRNA coding sequence
aagctgaagctgcataagtgc

SEQ ID NO: 40 - DNA, 43 bp, Artificial Sequence
  siRNA coding sequence
  misc_feature 22: n = A,T,C or G
aagctgaagctgcataagtgcngcacttatgcagcttcagctt

SEQ ID NO: 41 - DNA, 49 bp, Artificial Sequence
  siRNA coding sequence
aagctgaagctgcataagtgctttttgcgcacttatgcagcttcagctt

SEQ ID NO: 42 - DNA, 21 bp, Artificial Sequence
  siRNA coding sequence
aaatgaagagaccttcttcca

SEQ ID NO: 43 - DNA, 43 bp, Artificial Sequence
  siRNA coding sequence
  misc_feature 22: n = A,T,C or G
aaatgaagagaccttcttccantggaagaaggtctcttcattt

SEQ ID NO: 44 - DNA, 49 bp, Artificial Sequence
  siRNA coding sequence
aaatgaagagaccttcttccatttttgctggaagaaggtctcttcattt

SEQ ID NO: 45 - protein, 5 aa, Artificial Sequence
  synthetic proteolytic cleavage site
DDDDK

SEQ ID NO: 46 - protein, 4 aa, Artificial Sequence
  synthetic proteolytic cleavage site
IEGR

SEQ ID NO: 47 - protein, 6 aa, Artificial Sequence
  synthetic proteolytic cleavage site
LVPRGS

SEQ ID NO: 48 - protein, 8 aa, Artificial Sequence
  synthetic proteolytic cleavage site
HPFHLVIH

SEQ ID NO: 49 - protein, 6 aa, Artificial Sequence
  synthetic linker
AAAGGM

SEQ ID NO: 50 - protein, 14 aa, Artificial Sequence
  synthetic linker
AAAGGMPPAAAGGM

SEQ ID NO: 51 - protein, 6 aa, Artificial Sequence
  synthetic linker
AAAGGM

SEQ ID NO: 52 - protein, 16 aa, Artificial Sequence
  synthetic linker
PPAAAGGMPPAAAGGM

SEQ ID NO: 53 - DNA, 27 bp, Artificial Sequence
  primer
ctcacagtccggcagagcacgcggaac

SEQ ID NO: 54 - DNA, 29 bp, Artificial Sequence
  primer
cacggcgttgctgctatctgccagcatcc

What is claimed is:

1. A method of reducing cancer cell growth in an individual having a cancer selected from multiple myeloma, glioblastoma, glioma, neuroblastoma, astrocytoma, breast cancer, and lung cancer, the method comprising administering to the individual an effective amount of an antibody specific for a sulfatase-2 polypeptide, wherein said sulfatase comprises an amino acid sequence having at least about 95% amino acid sequence identity to the amino acid sequence set forth in SEQ ID NO:6, wherein the cancer overexpresses sulfatase-2, and wherein said administering reduces cancer cell growth.

2. The method of claim 1, wherein said antibody is a monoclonal antibody.

3. The method of claim 1, wherein said antibody is a sulfatase-binding antibody fragment.

4. The method of claim 1, wherein said antibody is specific for a sulfatase domain of the sulfatase.

5. The method of claim 1, wherein said antibody is specific for a coiled-coil domain of the sulfatase.

6. The method of claim 1, wherein said antibody is specific for a glucosamine-6-sulfate-related domain of the sulfatase.

7. The method of claim 1, wherein said antibody is specific for a hydrophilic domain of the sulfatase.

8. The method of claim 1, wherein said antibody is a humanized antibody.

9. The method of claim 1, wherein said administering is by injection.

10. The method of claim 1, wherein said administering comprises enteral delivery.

11. The method of claim 1, wherein said administering is at or near the site of a tumor.

12. The method of claim 1, wherein said antibody is administered in a formulation comprising one or more of an additive, a binder, a carrier, a diluent, a buffering agent, and a preservative.

13. The method of claim 1, wherein said cancer cell exhibits autocrine Wnt signaling.

14. The method of claim 13, wherein said cancer is lung cancer.

15. The method of claim 1, wherein said administering reduces cancer cell growth by at least about 10%.

16. The method of claim 1, wherein said antibody inhibits endoglucosamine-6-sulfatase activity of said sulfatase.

17. The method of claim 1, wherein said cancer is breast cancer.

18. The method of claim 1, wherein said sulfatase comprises an amino acid sequence having at least about 98% amino acid sequence identity to the amino acid sequence set forth in SEQ ID NO:6.

19. A method of reducing cancer cell growth in an individual having a cancer selected from multiple myeloma, glioblastoma, glioma, neuroblastoma, astrocytoma, breast cancer, pancreatic cancer, and lung cancer, the method comprising administering to the individual an effective amount of an antibody specific for a sulfatase-2 polypeptide, wherein said sulfatase comprises an amino acid sequence having at least about 95% amino acid sequence identity to the amino acid sequence set forth in SEQ ID NO:6, wherein said antibody is specific for a coiled-coil domain of the sulfatase, wherein the cancer overexpresses sulfatase-2, and wherein said administering reduces cancer cell growth.

20. A method of reducing pancreatic cancer cell growth in an individual, the method comprising administering to the individual an effective amount of an antibody specific for a sulfatase-2 polypeptide, wherein said sulfatase comprises an amino acid sequence having at least about 95% amino acid sequence identity to the amino acid sequence set forth in SEQ ID NO:6, wherein the cancer overexpresses sulfatase-2, and wherein said administering reduces pancreatic cancer cell growth.

21. The method of claim 20, wherein said antibody is a monoclonal antibody.

22. The method of claim 20, wherein said antibody is a sulfatase-binding antibody fragment.

23. The method of claim 20, wherein said antibody is specific for a sulfatase domain of the sulfatase.

24. The method of claim 20, wherein said antibody is specific for a coiled-coil domain of the sulfatase.

25. The method of claim 20, wherein said antibody is specific for a glucosamine-6-sulfate-related domain of the sulfatase.

26. The method of claim 20, wherein said antibody is specific for a hydrophilic domain of the sulfatase.

27. The method of claim 20, wherein said antibody is a humanized antibody.

28. The method of claim 20, wherein said administering is by injection.

29. The method of claim 20, wherein said administering comprises enteral delivery.

30. The method of claim 20, wherein said administering is at or near the site of a tumor.

31. The method of claim 20, wherein said antibody is administered in a formulation comprising one or more of an additive, a binder, a carrier, a diluent, a buffering agent, and a preservative.

32. The method of claim 20, wherein said antibody inhibits endoglucosamine-6-sulfatase activity of said sulfatase.

33. The method of claim 20, wherein said sulfatase comprises an amino acid sequence having at least about 98% amino acid sequence identity to the amino acid sequence set forth in SEQ ID NO:6.

* * * * *